US010184936B2

(12) United States Patent
Dixon et al.

(10) Patent No.: US 10,184,936 B2
(45) Date of Patent: Jan. 22, 2019

(54) ACTIVATION OF BIOLUMINESCENCE BY STRUCTURAL COMPLEMENTATION

(71) Applicant: Promega Corporation, Madison, WI (US)

(72) Inventors: Andrew S. Dixon, Verona, WI (US); Lance Encell, Fitchburg, WI (US); Mary Hall, Waunakee, WI (US); Keith Wood, Mt. Horeb, WI (US); Monika Wood, Mt. Horeb, WI (US); Marie Schwinn, Madison, WI (US); Brock F. Binkowski, Sauk City, WI (US); Hicham Zegzouti, Madison, WI (US); Nidhi Nath, Madison, WI (US); Subhanjan Mondal, Middleton, WI (US); Said Goueli, Fitchburg, WI (US); Poncho Meisenheimer, San Luis Obispo, CA (US); Thomas Kirkland, Atascadero, CA (US); James Unch, Arroyo Grande, CA (US); Dileep K. Pulukkunat, Middleton, WI (US); Matthew Robers, Madison, WI (US); Melanie Dart, Madison, WI (US); Thomas Machleidt, Madison, WI (US)

(73) Assignee: Promega Corporation, Madison, WI (US)

(*) Notice: Subject to any disclaimer, the term of this patent is extended or adjusted under 35 U.S.C. 154(b) by 0 days.

(21) Appl. No.: 15/899,219

(22) Filed: Feb. 19, 2018

(65) Prior Publication Data
US 2018/0196038 A1 Jul. 12, 2018

Related U.S. Application Data

(63) Continuation of application No. 15/717,534, filed on Sep. 27, 2017, which is a continuation of application No. 15/073,249, filed on Mar. 17, 2016, now Pat. No. 9,869,670, which is a continuation of application No. 14/209,610, filed on Mar. 13, 2014, now Pat. No. 9,797,890.

(60) Provisional application No. 61/791,549, filed on Mar. 15, 2013.

(51) Int. Cl.
| G01N 31/00 | (2006.01) |
| G01N 33/53 | (2006.01) |
| G01N 33/533 | (2006.01) |
| C07K 14/435 | (2006.01) |
| C12Q 1/66 | (2006.01) |
| C07K 7/08 | (2006.01) |
| A61K 51/08 | (2006.01) |
| C12N 9/02 | (2006.01) |
| G01N 33/542 | (2006.01) |
| G01N 33/58 | (2006.01) |

(52) U.S. Cl.
CPC .......... *G01N 33/533* (2013.01); *A61K 51/08* (2013.01); *C07K 7/08* (2013.01); *C07K 14/43509* (2013.01); *C12N 9/0069* (2013.01); *C12Q 1/66* (2013.01); *G01N 33/542* (2013.01); *G01N 33/581* (2013.01)

(58) Field of Classification Search
None
See application file for complete search history.

(56) References Cited

U.S. PATENT DOCUMENTS

| 6,242,345 | B1 | 6/2001 | Levy |
| 6,270,964 | B1 | 8/2001 | Michnick et al. |
| 7,314,729 | B2 | 1/2008 | Goueli et al. |
| 7,601,517 | B2 | 10/2009 | Gambhir et al. |
| 8,057,824 | B2 | 11/2011 | Roorda et al. |
| 8,241,860 | B2 | 8/2012 | Ghosh et al. |
| 8,557,970 | B2 | 10/2013 | Encell et al. |
| 8,669,103 | B2 | 3/2014 | Binkowski et al. |
| 8,809,529 | B2 | 8/2014 | Klaubert et al. |
| 9,797,889 | B2 * | 10/2017 | Dixon .................. G01N 33/533 |
| 9,797,890 | B2 * | 10/2017 | Dixon .................... A61K 51/08 |
| 9,869,670 | B2 * | 1/2018 | Dixon .................... A61K 51/08 |
| 2009/0075313 | A1 | 3/2009 | Massoud et al. |
| 2014/0348747 | A1 | 11/2014 | Dixon et al. |
| 2015/0125438 | A1 | 5/2015 | Kim et al. |

FOREIGN PATENT DOCUMENTS

| EP | 1156103 | 11/2001 |
| WO | WO1993/06868 | 4/1993 |
| WO | WO1994/08629 | 4/1994 |
| WO | WO1994/09056 | 4/1994 |
| WO | WO1996/26754 | 9/1996 |
| WO | WO1998/34120 | 8/1998 |

(Continued)

OTHER PUBLICATIONS

Golla et al, A homogeneous enzyme fragment complementation cyclic AMP screen for GPCR agonists, J Biomol Screen, 2002, 7(6):515-25.
Berman et al., The Protein Data Bank, Nucleic Acids Res., 2000, 28:235-242.
Hall et al., Engineered luciferase reporter from a deep sea shrimp utilizing a novel imidazopyrazinone substrate, ACS Chem Biol, 2012, 7:1848-1857.
Inouye et al., Secretional luciferase of the luminous shrimp *Oplophorus gracilirostris*: cDNA cloning of a novel imidazopyrazinone luciferase(1), FEBS Lett. Sep. 8, 2000;481(1):19-25.

(Continued)

*Primary Examiner* — Lisa V Cook
(74) *Attorney, Agent, or Firm* — Casimir Jones SC; David W. Staple

(57) ABSTRACT

Provided herein are compositions and methods for the assembly of a bioluminescent complex from two or more non-luminescent (e.g., substantially non-luminescent) peptide and/or polypeptide units. In particular, bioluminescent activity is conferred upon a non-luminescent polypeptide via structural complementation with another, complementary non-luminescent peptide.

3 Claims, 204 Drawing Sheets

Specification includes a Sequence Listing.

(56) References Cited

FOREIGN PATENT DOCUMENTS

| WO | WO2012/061529 | 5/2012 |
| WO | WO2014/093677 | 6/2014 |
| WO | WO2014/151736 | 9/2014 |

OTHER PUBLICATIONS

Kerppola, Complementary methods for studies of protein interactions in living cells, Nat Methods, 2006, 3:969-971.

Komiya et al., Homogeneous sandwich immunoassay based on the enzymatic complementation induced by single-chain Fv fragments, Anal Biochem, 2004, 327(2):241-6.

Lim et al., Noncompetitive detection of low molecular weight peptides by open sandwich immunoassay, Anal Chem., 2007, 79(16):6193-200.

Mie et al. Development of a homogeneous immunoassay system using protein a fusion fragmented Renilla luciferase, The Analyst, 2012, 137(5):1085-9.

Shirasu et al., Noncompetitive immunodetection of benzaldehyde by open sandwich ELISA, Anal Sci., 2009, 25(9):1095-100.

Stains et al., A general approach for receptor and antibody-targeted detection of native proteins utilizing split-luciferase reassembly, ACS Chem Biol., 2010, 5(10):943-52.

The Uniprot Consortium, "Reorganizing the protein space at the Universal Protein Resource (UniProt)", Nucleic Acids Res., 2012, 40: D71-D75.

Tomalia et al. In Angew. Chem. Int. Ed. Engl. 29:138-175 (1990).

Ueda et al., An optimized homogeneous noncompetitive immunoassay based on the antigen-driven enzymatic complementation, J Immunol Methods, 2003, 279(1-2):209-18.

Ueda et al., Open sandwich ELISA: a novel immunoassay based on the interchain interaction of antibody variable region, Nat Biotechnol., 1996, 14(13):1714-8.

Yang et al., Homogeneous enzyme immunoassay modified for application to luminescence-based biosensors, Anal Biochem, 2005, 336(1):102-7.

International Search Report and Written Opinion for PCT/US2014/026354, dated July 31, 2014, 15 pages.

Supplementary European Search Report for EP14769752, dated Jun. 24, 2016, 10 pages.

* cited by examiner

Figure 10
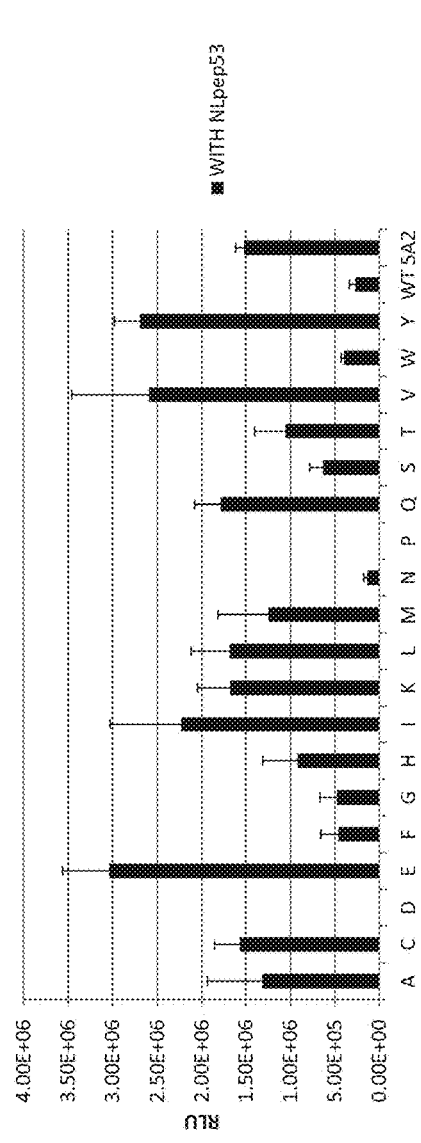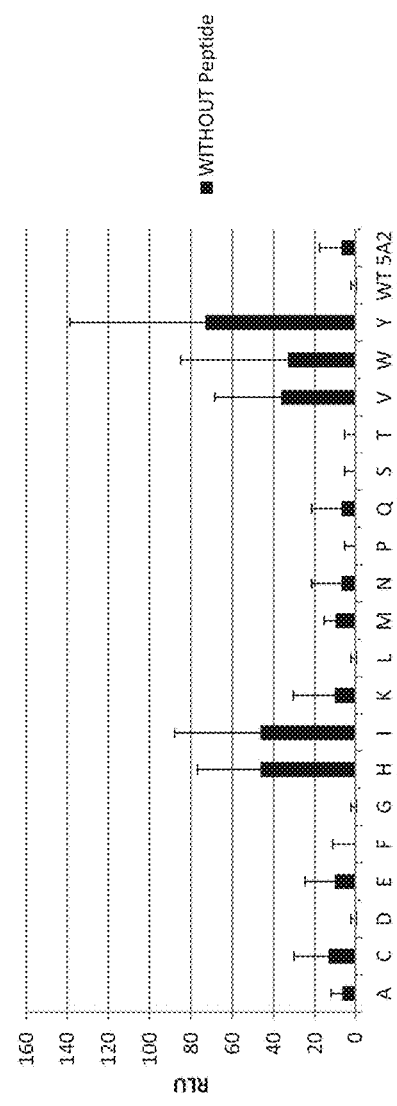

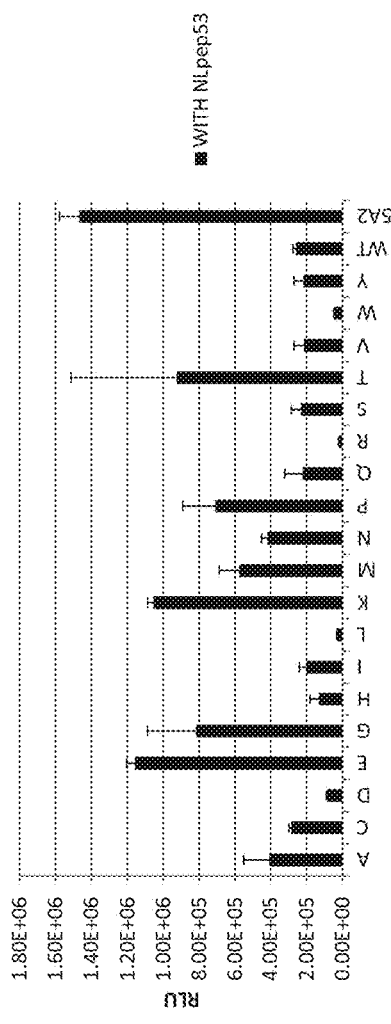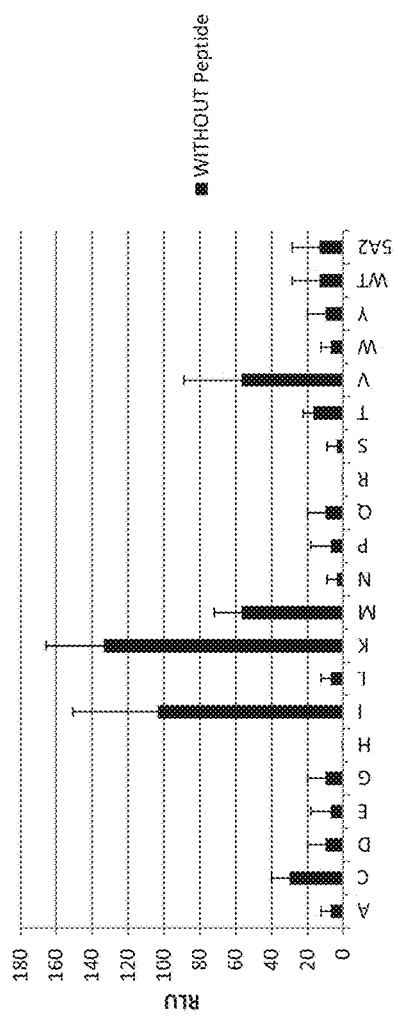
Figure 13

Figure 15
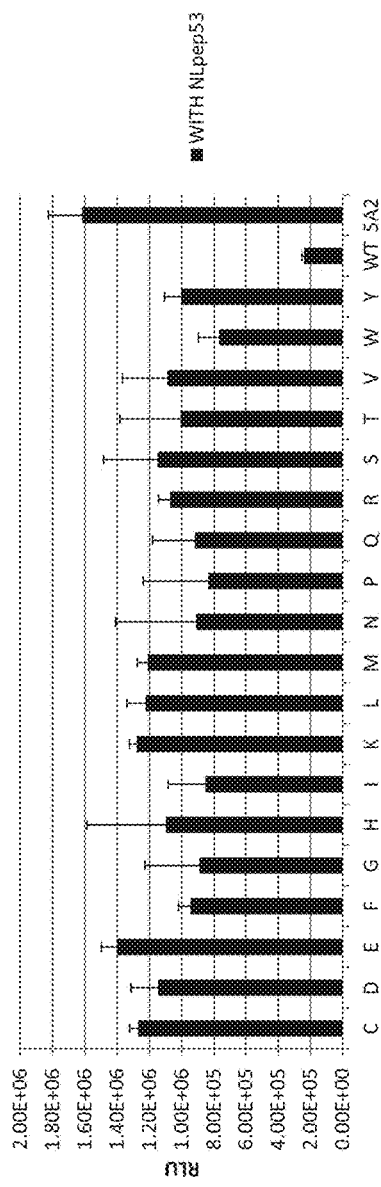
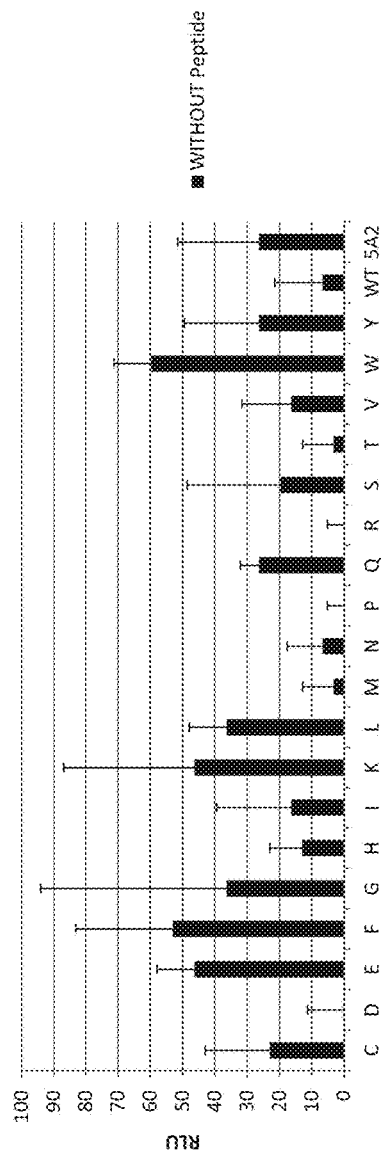

Figure 16
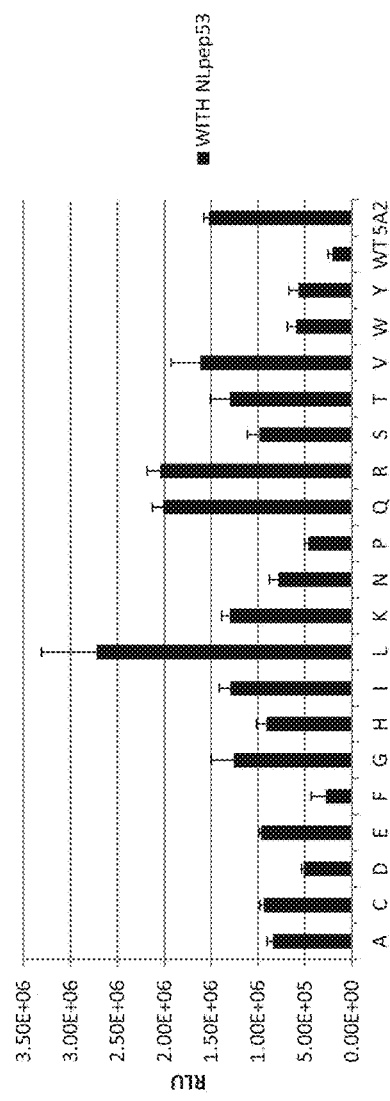
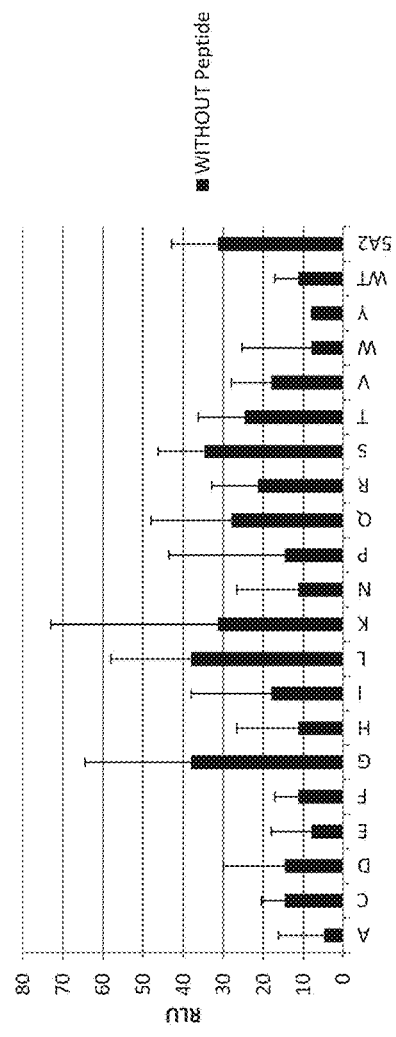

Figure 17
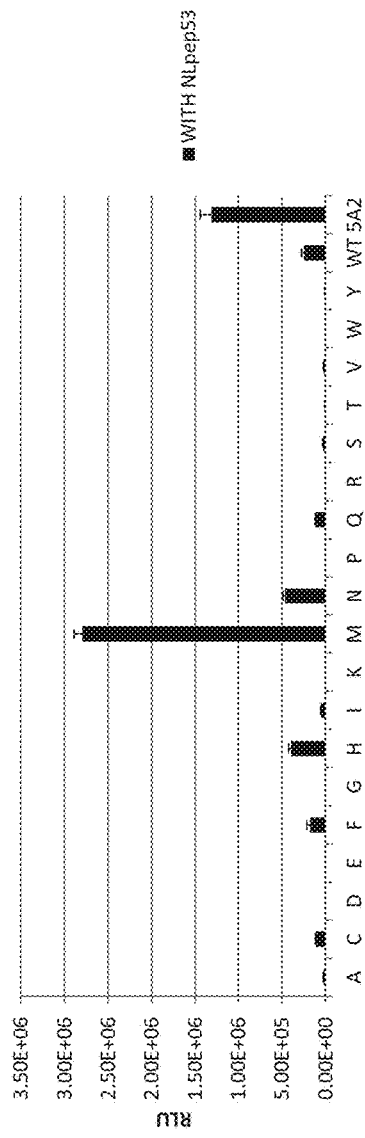
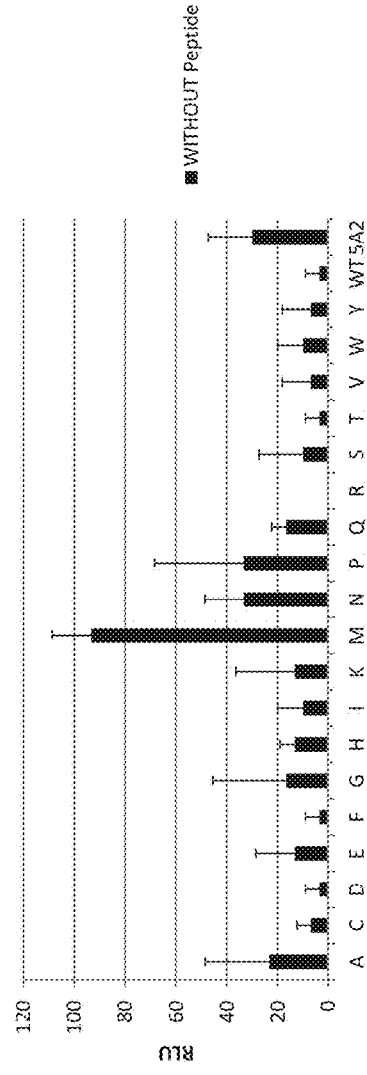

Figure 18
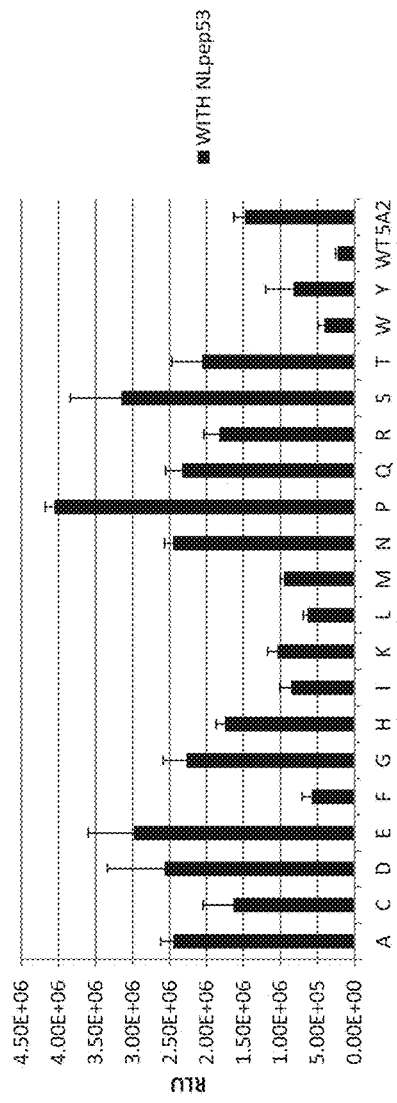
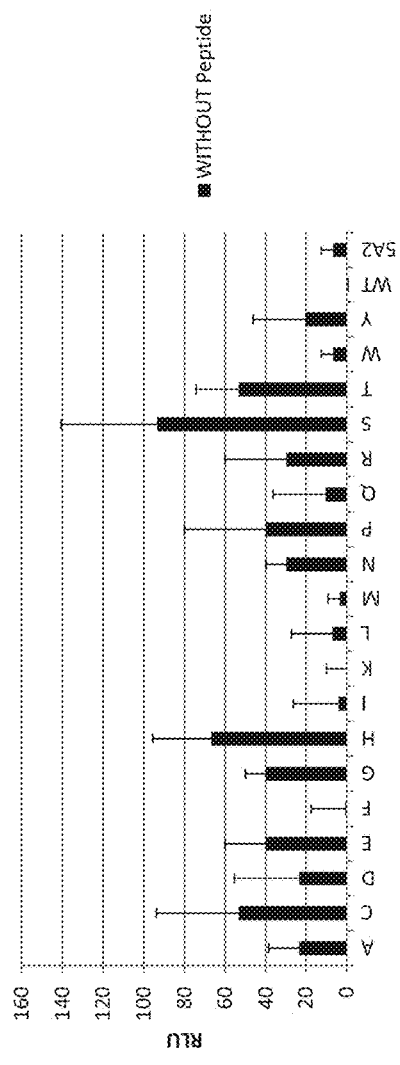

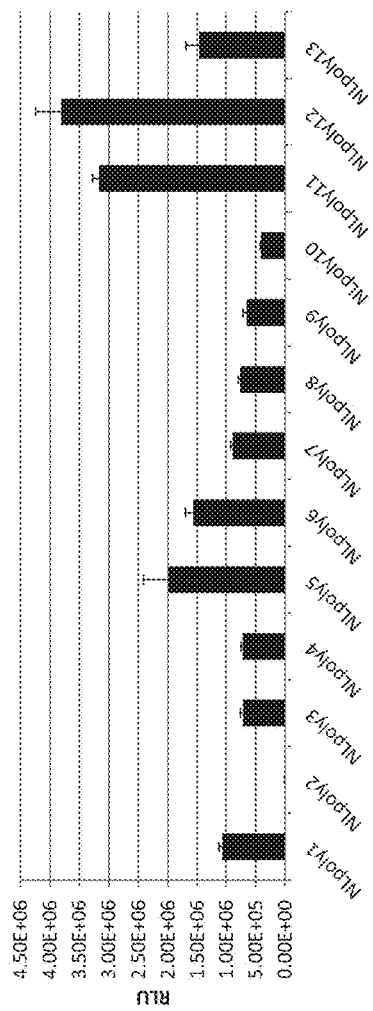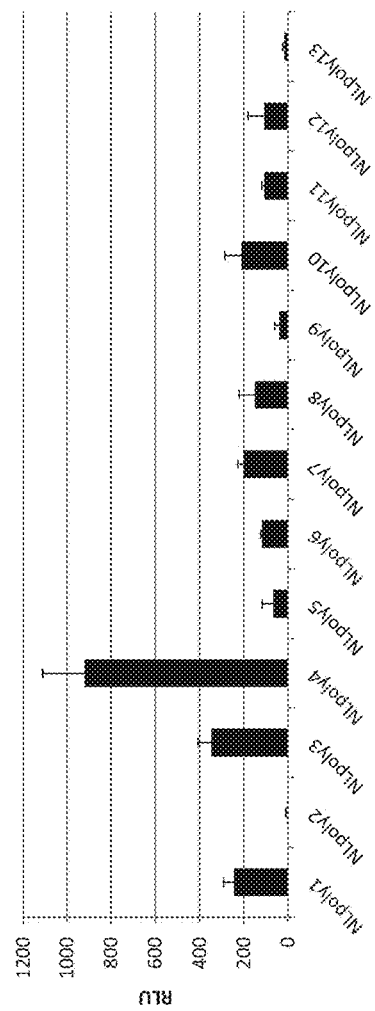
Figure 24

Alternating lanes are crude and soluble fractions

5PD1 has 1 amino acid removed from C-terminus, 5PD2 has 2 amino acids removed from C-terminus, ...., 5PD5 has 5 amino acids removed from the C-terminus.

Figure 88

Peptide Array 1 Screens

Peptide Array 1 Screens

1. NLpep78-HT lysate
2. Flow through of NLpep78-HT lysate
3. 8S lysate
4. Flow through of 8S lysate
5. Wash 1
6. Wash 2
7. Wash 3
8. Wash 4
9. Elution 1
10. Elution 2

Figure 95

| NLpoly:NLpep | $k_{on}$ (nM/min) | $k_{off}$ (min$^{-1}$) | $K_D$ (off/on, μM) |
|---|---|---|---|
| WT:WT | 4.19e-5 | 1.13 | 26876 |
| WT:78 | 1.50e-4 | 0.26 | 1752 |
| WT:79 | 1.36e-4 | 0.76 | 5575 |
| 11S:WT | 2.99e-3 | 1.88 | 629 |
| 11S:78 | 1.86e-2 | 0.49 | 26 |
| 11S:79 | 3.10e-2 | 1.29 | 42 |

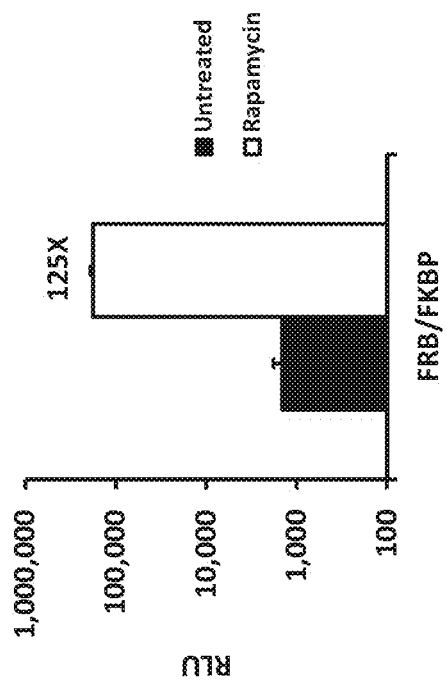
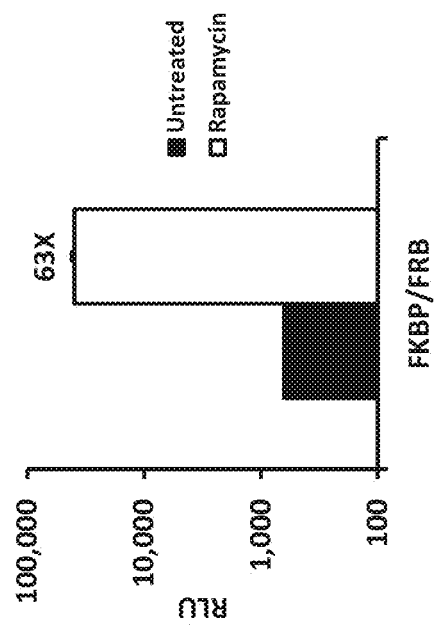
Figure 130

Figure 147
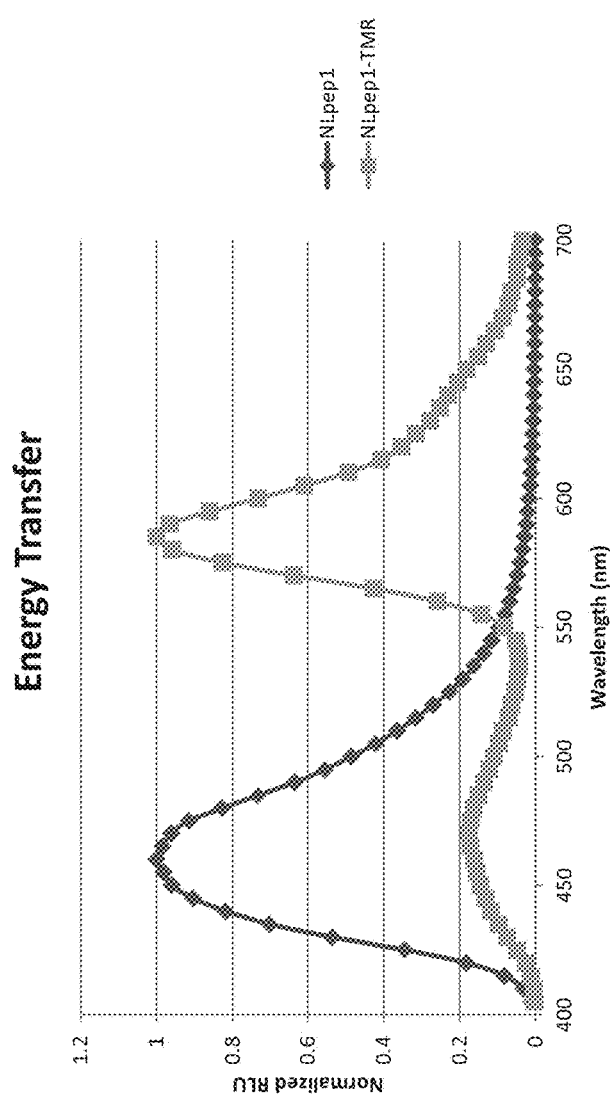
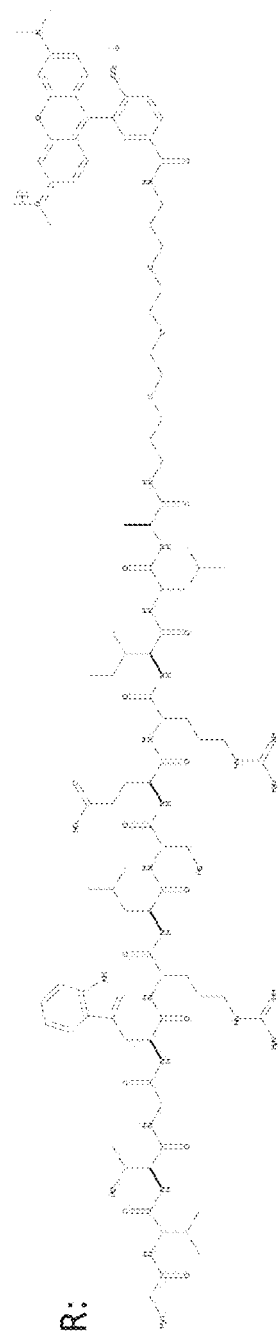
NLpep1-TMR:

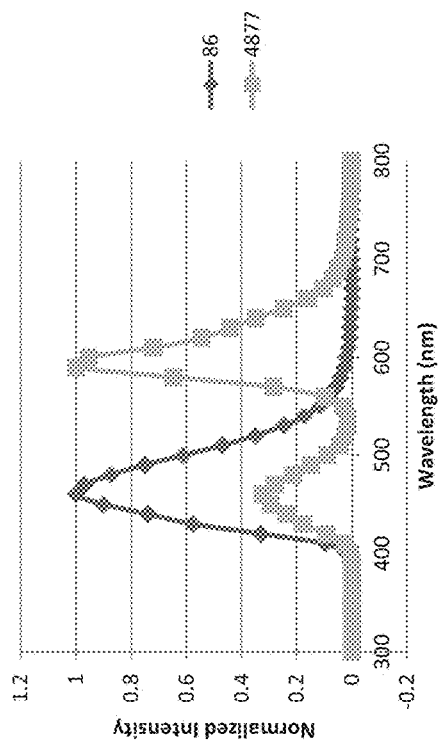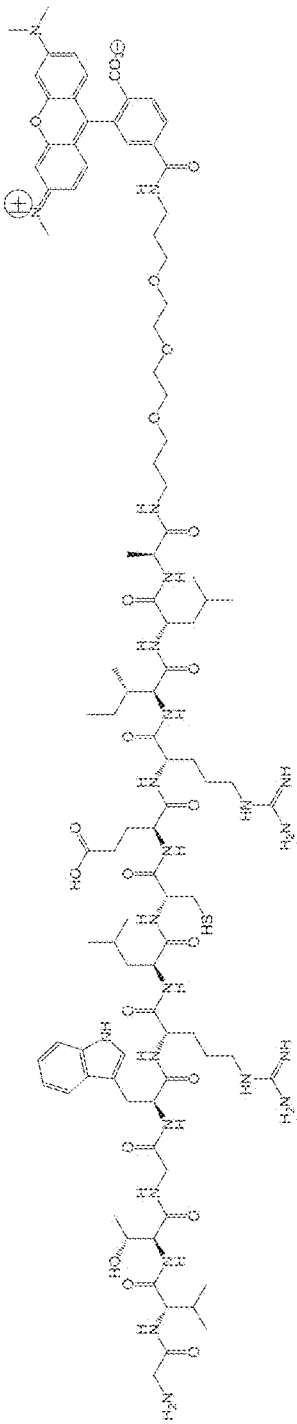
Figure 152
PBI-4877:

Figure 153
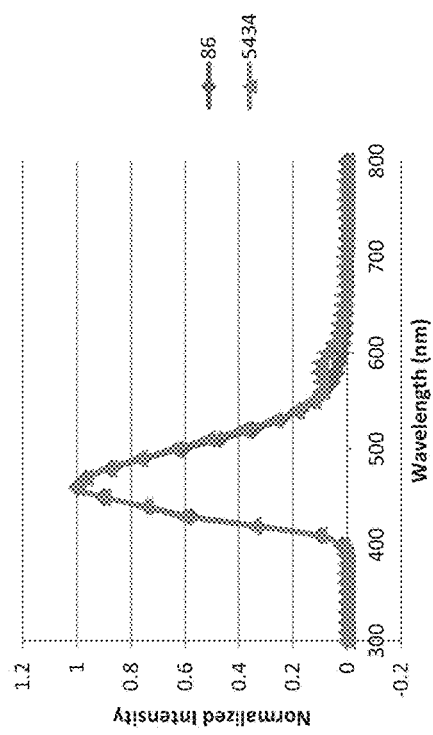
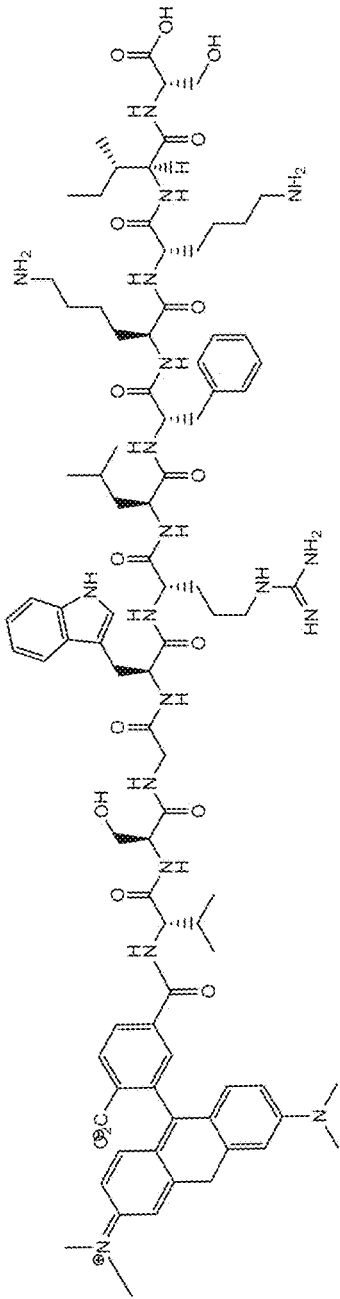
PBI-5434:

Figure 154
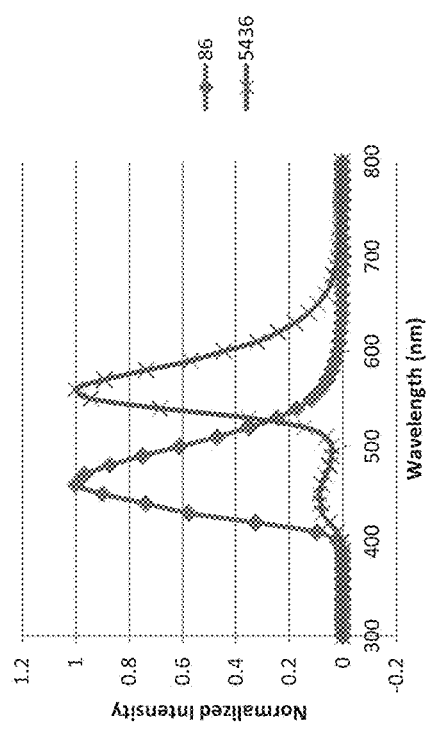
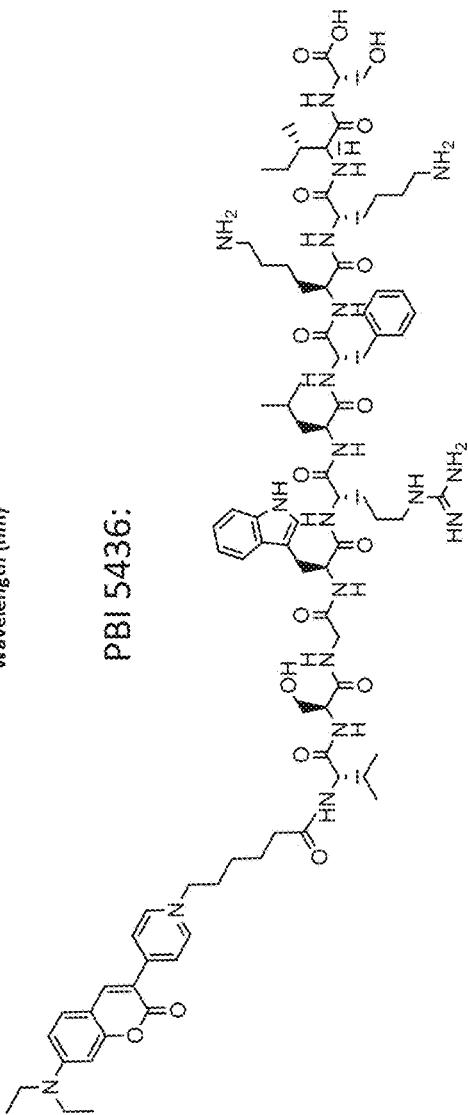
PBI 5436:

Figure 157
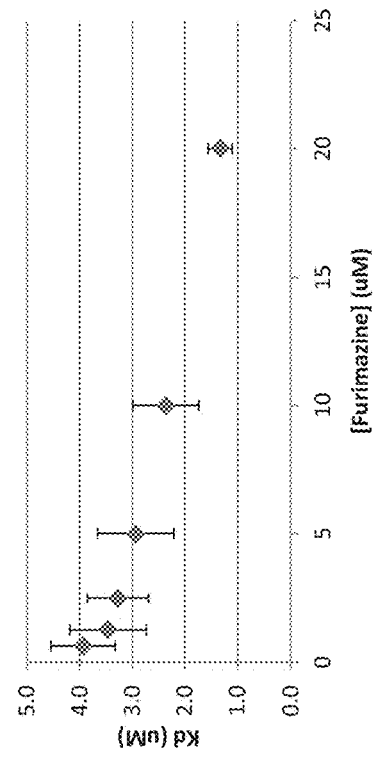
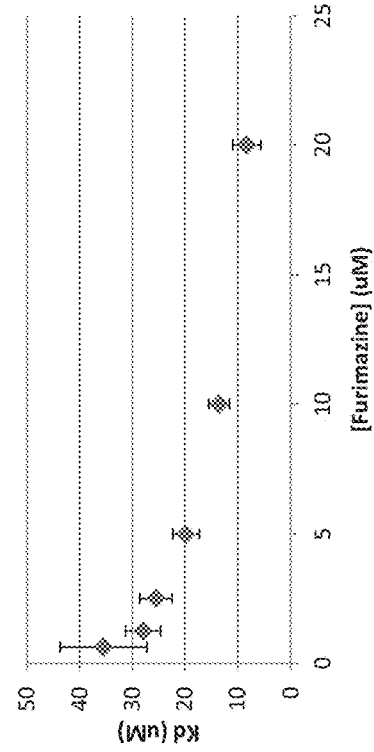

|   | 1 | 2 | 3 | 4 | 5 | 6 | 7 | 8 | 9 | 10 | 11 | 12 | 13 |
|---|---|---|---|---|---|---|---|---|---|----|----|----|----|
| WT | G | V | T | G | W | R | L | C | E | R | I | L | A |
| 86 | - | V | S | G | W | R | L | F | K | K | I | S | - |
| 114 | - | V | T | G | Y | R | L | F | E | E | I | L | - |

High
Low

Need protocol, how much 11S

Figure 175
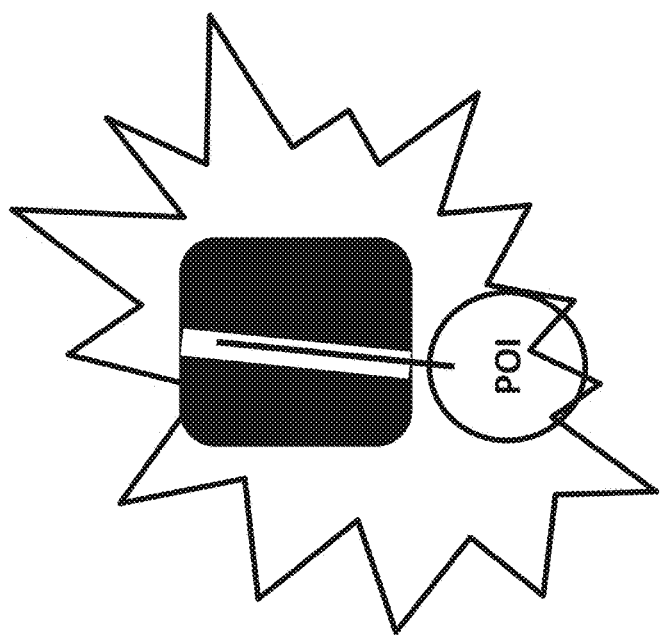
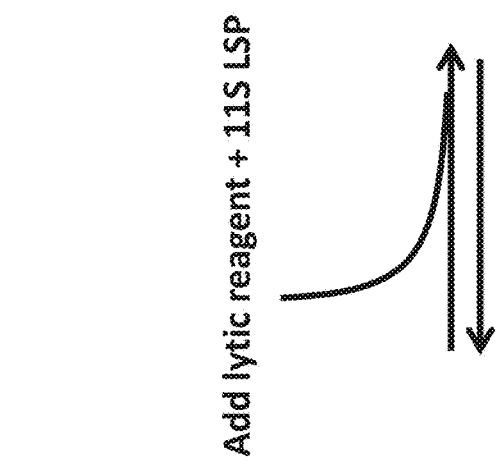
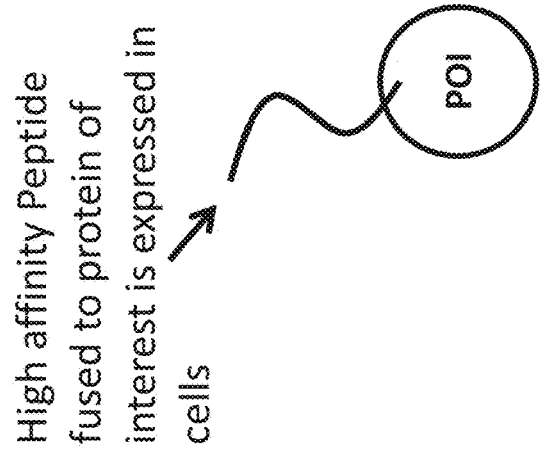

Figure 180

High affinity (spontaneous) peptides

| | | | | | 157 | 159 | 161 | 163 | 165 | 167 | 169 |
|---|---|---|---|---|---|---|---|---|---|---|---|
| | Wt | T | I | N | G | V T G | W R L | C E R | I L | A |
| SEQ ID NO: 374 | 78 | | | | N | V T G | W R L | F K K | I S | N |
| SEQ ID NO: 378 | 80 | | | | – | V S G | W R L | F K K | I S | N |
| SEQ ID NO: 2336 | 80* | | | | – | V S G | W R L | F K K | I S | A |
| SEQ ID NO: 384 | 83 | | | | N | V S G | W R L | F K K | I S | N |
| SEQ ID NO: 2337 | 83* | | | | G | V S G | W R L | F K K | I S | A |
| SEQ ID NO: 2367 | 86 | | | | – | V S G | W R L | F K K | I S | – |
| SEQ ID NO: 2339 | 80+S | | | S | N | V S G | W R L | F K K | I S | A |
| SEQ ID NO: 2338 | 80+S | | | S | S | V S G | W R L | F K K | I S | N |
| SEQ ID NO: 2340 | 80+NS* | | | N | S | V S G | W R L | F K K | I S | A |
| SEQ ID NO: 2341 | 80+NS | | | N | S | V S G | W R L | F K K | I S | – |
| SEQ ID NO: 2342 | 83+S | | | S | N | V S G | W R L | F K K | I S | – |
| SEQ ID NO: 2343 | 83+S* | | | S | G | V S G | W R L | F K K | I S | – |
| SEQ ID NO: 2344 | 83+NS | N | | | N | V S G | W R L | F K K | I S | – |
| SEQ ID NO: 2345 | 83+NS* | N | | | N | V S G | W R L | F K K | I S | – |
| SEQ ID NO: 2346 | 86+S | | | S | S | V S G | W R L | F K K | I S | – |
| SEQ ID NO: 2347 | 86+NS | | | N | S | V S G | W R L | F K K | I S | – |
| SEQ ID NO: 2348 | 78+S | | | S | N | V T G | W R L | F K K | I S | N |
| SEQ ID NO: 2344 | 78+NS | N | | | N | V T G | W R L | F K K | I S | N |

Synthetic Dark/Quencher peptides

| | | 157 | 159 | 161 | 163 | 165 | 167 | 169 | |
|---|---|---|---|---|---|---|---|---|---|
| Wt | | T I N G | V T G | W R L | C E R | I L | A | | |

Dark peptides:
| | | | | | | |
|---|---|---|---|---|---|---|
| 7mer dark | G W A L F K K | | | SEQ ID NO: 2351 |
| Trp 11mer | V T G W A L F E E I L | | SEQ ID NO: 2352 |
| Tyr 11mer | V T G Y A L F E E I L | | SEQ ID NO: 2355 |

Quencher peptides:
| | | | |
|---|---|---|---|
| DAB-G W A L F K K | | SEQ ID NO: 2351 |
| DAB-V T G W A L F E E I L | SEQ ID NO: 2352 |
| DAB-V T G Y A L F E E I L | SEQ ID NO: 2355 |

DAB=Dabcyl(475 nm quencher)+dPEG4 spacer

These dark/quencher peptides can potentially be added to 11S for the purpose of reducing background luminescence produced with Fz substrate in the absence of any peptide. The substitution of Ala for Arg (catalytic) at position 162 should make the peptides essentially dark.

Figure 182A
DP = "dark peptide" = a peptide that binds to LSP with relatively high affinity but produces minimal or no luminescence
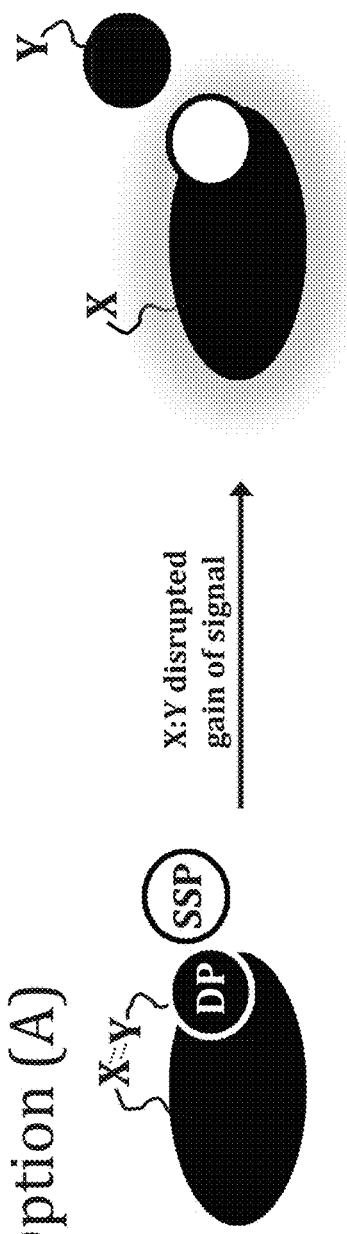
Option (A)
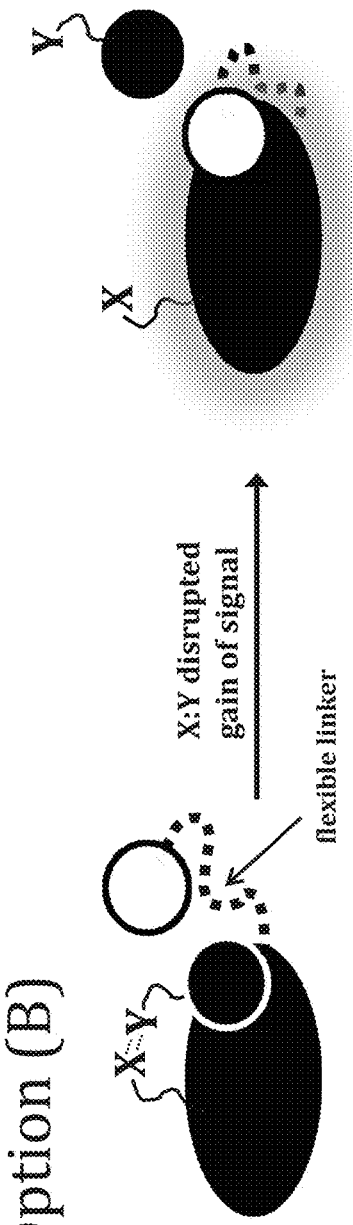
Option (B)

Figure 182B

Option (B)

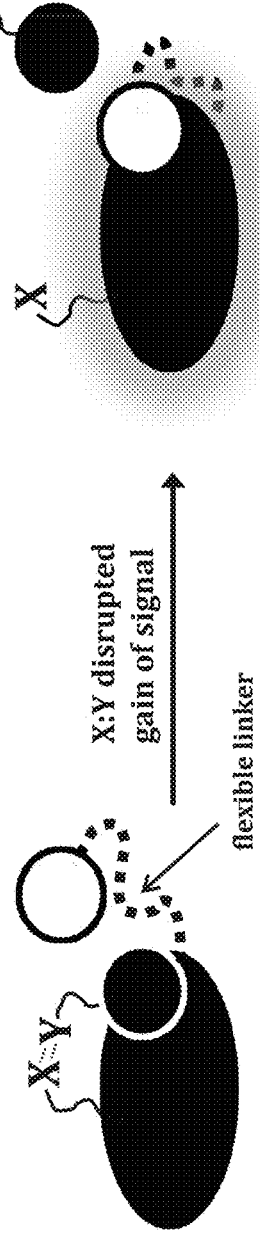

X:Y disrupted
gain of signal flexible linker

The ability for this to work is likely dependent on the proper combination of LSP sequence, DP sequence, covalently-attached SSP sequence, and linker sequence. Possible variations and combinations to examine include but are not limited to the following:

X-NLuc(1-156) – 0aa linker – NLuc(157-169)
X-NLuc(1-156) – 0aa linker – NLuc(158-168)
X-NLuc(1-156) – 0aa linker – NLuc(160-168)
X-NLuc(1-156) – 0aa linker – NLuc(158-166)
X-NLuc(1-156) – 0aa linker – NLuc(160-166)

X-NLuc(1-156) – 15aa Gly-Ser linker – NLuc(157-169)
X-NLuc(1-156) – 15aa Gly-Ser linker – NLuc(158-168)
X-NLuc(1-156) – 15aa Gly-Ser linker – NLuc(160-168)
X-NLuc(1-156) – 15aa Gly-Ser linker – NLuc(158-166)
X-NLuc(1-156) – 15aa Gly-Ser linker – NLuc(160-166)

X-NLuc(1-156) – 30aa Gly-Ser linker – NLuc(157-169)
X-NLuc(1-156) – 30aa Gly-Ser linker – NLuc(158-168)
X-NLuc(1-156) – 30aa Gly-Ser linker – NLuc(160-168)
X-NLuc(1-156) – 30aa Gly-Ser linker – NLuc(158-166)
X-NLuc(1-156) – 30aa Gly-Ser linker – NLuc(160-166)

X-NLuc(1-156) – 45aa Gly-Ser linker – NLuc(157-169)
X-NLuc(1-156) – 45aa Gly-Ser linker – NLuc(158-168)
X-NLuc(1-156) – 45aa Gly-Ser linker – NLuc(160-168)
X-NLuc(1-156) – 45aa Gly-Ser linker – NLuc(158-166)
X-NLuc(1-156) – 45aa Gly-Ser linker – NLuc(160-166)

Figure 191
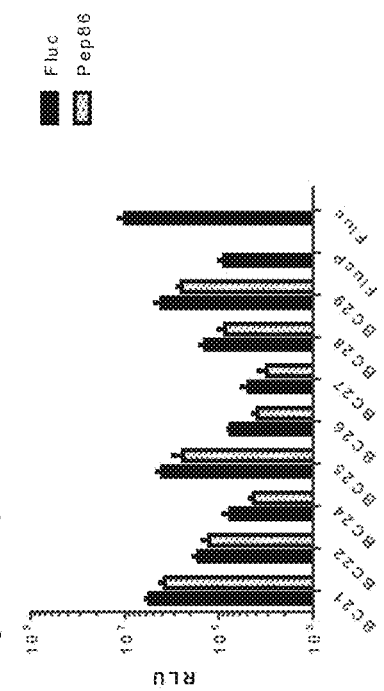
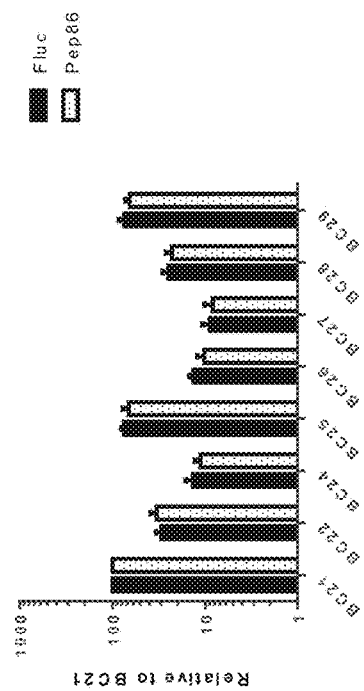

ACTIVATION OF BIOLUMINESCENCE BY STRUCTURAL COMPLEMENTATION

CROSS-REFERENCE TO RELATED APPLICATION

The present application is a continuation of U.S. patent application Ser. No. 15/727,534, filed Sep. 27, 2017, which is a continuation of U.S. patent application Ser. No. 15/073,249, filed Mar. 17, 2016, which is a continuation of U.S. patent application Ser. No. 14/209,610, filed Mar. 13, 2014, which claims priority to U.S. Provisional Patent Application Ser. No. 61/791,549 filed Mar. 15, 2013, each of which is hereby incorporated by reference in its entirety.

FIELD

Provided herein are compositions and methods for the assembly of a bioluminescent complex from two or more non-luminescent (e.g., substantially non-luminescent) peptide and/or polypeptide units. In particular, bioluminescent activity is conferred upon a non-luminescent polypeptide via structural complementation with another, complementary non-luminescent peptide.

BACKGROUND

Biological processes rely on covalent and non-covalent interactions between molecules, macromolecules and molecular complexes. In order to understand such processes, and to develop techniques and compounds to manipulate them for research, clinical and other practical applications, it is necessary to have tools available to detect and monitor these interactions. The study of these interactions, particularly under physiological conditions (e.g. at normal expression levels for monitoring protein interactions), requires high sensitivity.

SUMMARY

The present invention relates to compositions comprising complementary non-luminescent amino acid chains (e.g., substantially non-luminescent peptides and/or polypeptides that are not fragments of a preexisting protein), complexes thereof, and methods of generating an optically detectable bioluminescent signal upon association of the non-luminescent amino acid chains (e.g., peptides and/or polypeptides). In some embodiments, the present invention provides two or more non-luminescent, or substantially non-luminescent peptides and/or polypeptides, that, when brought together, assemble into a bioluminescent complex. In some embodiments, a pair of substantially non-luminescent peptide and/or polypeptide units assembles into a bioluminescent complex. In other embodiments, three or more substantially non-luminescent peptide and/or polypeptide units assemble into a bioluminescent complex (e.g., ternary complex, tertiary complex, etc.). Provided herein are technologies for detecting interactions between molecular entities (e.g., proteins, nucleic acids, carbohydrates, small molecules (e.g., small molecule libraries)) by correlating such interactions to the formation of a bioluminescent complex of otherwise non-luminescent (e.g., substantially non-luminescent) amino acid chains.

In some embodiments, the assembled pair catalyzes a chemical reaction of an appropriate substrate into a high energy state, and light is emitted. In some embodiments, a bioluminescent complex exhibits luminescence in the presence of substrate (e.g., coelenterazine, furimazine, etc.).

Although the embodiments described herein primarily describe and refer to complementary, non-luminescent amino acid chains that form bioluminescent complexes, it is noted that the present technology can equally be applied to other detectable attributes (e.g., other enzymatic activities, generation of a fluorophore, generation of a chromophore, etc.). The embodiments described herein relating to luminescence should be viewed as applying to complementary, substantially non-enzymatically active amino acid chains (e.g., peptides and/or polypeptides that are not fragments of a preexisting protein) that separately lack a specified detectable activity (e.g., enzymatic activity) or substantially non-enzymatically active subunits of a polypeptide, complexes thereof, and methods of generating the detectable activity (e.g., an enzymatic activity) upon association of the complementary, substantially non-enzymatically active amino acid chains (e.g., peptides and/or polypeptides). Further, embodiments described herein that refer to non-luminescent peptides and/or polypeptides are applied, in some embodiments, to substantially non-luminescent peptides and/or polypeptides.

The invention is further directed to assays for the detection of molecular interactions between molecules of interest by linking the interaction of a pair of non-luminescent peptides/polypeptides to the interaction molecules of interest (e.g., transient association, stable association, complex formation, etc.). In such embodiments, a pair of a non-luminescent elements are tethered (e.g., fused) to molecules of interest and assembly of the bioluminescent complex is operated by the molecular interaction of the molecules of interest. If the molecules of interest engage in a sufficiently stable interaction, the bioluminescent complex forms, and a bioluminescent signal is generated. If the molecules of interest fail to engage in a sufficiently stable interaction, the bioluminescent complex will not form or only form weakly, and a bioluminescent signal is not detectable or is substantially reduced (e.g., substantially undetectable, essentially not detectable, etc.). In some embodiments, the magnitude of the detectable bioluminescent signal is proportional (e.g., directly proportional) to the amount, strength, favorability, and/or stability of the molecular interactions between the molecules of interest.

In some embodiments, the present invention provides peptides comprising an amino acid sequence having less than 100% (e.g., 20% . . . 30% . . . 40% . . . 50% . . . 60% . . . 70% . . . 80%, or more) sequence identity with SEQ ID NO: 2, wherein a detectable bioluminescent signal is produced when the peptide contacts a polypeptide consisting of SEQ ID NO: 440. In some embodiments, the present invention provides peptides comprising an amino acid sequence having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 2, wherein a detectable bioluminescent signal is produced when the peptide contacts a polypeptide consisting of SEQ ID NO: 440. In some embodiments, a detectable bioluminescent signal is produced when the peptide contacts a polypeptide having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 440. In certain embodiments, the detectable bioluminescent signal is produced, or is substantially increased, when the peptide associates with the polypeptide comprising or consisting of SEQ ID NO: 440, or a portion thereof. In preferred embodiments, the peptide exhibits alteration (e.g., enhancement) of one or more traits compared to a peptide of SEQ ID NO: 2, wherein the traits are selected from: affinity for the polypeptide consisting of SEQ ID NO: 440, expression, intracellular solubility, intracellular stability and bioluminescent activity when combined with the polypeptide consisting of SEQ ID NO: 440. Although not limited to these sequences, the peptide amino acid sequence may be selected from amino acid sequences of SEQ ID NOS: 3-438 and 2162-2365. In some embodiments, fusion polypeptides are provided that comprise: (a) an above described peptide, and (b) a first interaction polypeptide that forms a complex with a second interaction polypeptide upon contact of the first interaction polypeptide and the second interaction polypeptide. In certain embodiments, bioluminescent complexes are provided that comprise: (a) a first fusion polypeptide described above and (b) a second fusion polypeptide comprising: (i) the second interaction polypeptide and (ii) a complement polypeptide that emits a detectable bioluminescent signal when associated with the peptide comprising an amino acid sequence having less than 100% and greater than 40% sequence identity with SEQ ID NO: 2; wherein the first fusion polypeptide and second fusion polypeptide are associated; and wherein the peptide comprising an amino acid sequence having less than 100% and greater than 40%, sequence identity with SEQ ID NO: 2 and the complement polypeptide are associated.

In some embodiments, the present invention provides polypeptides comprising an amino acid sequence having less than 100% sequence identity with SEQ ID NO: 440, wherein a detectable bioluminescent signal is produced when the polypeptide contacts a peptide consisting of SEQ ID NO: 2. In some embodiments, the present invention provides polypeptides comprising an amino acid sequence having less than 100% and greater than 40% (e.g., >40%, >45%, >50°6, >55%, >60%, >65%, >70%, >75%, >80%, >85%, >90%, >95%, >98%, >99%) sequence identity with SEQ ID NO: 440, wherein a detectable bioluminescent signal is produced when the polypeptide contacts a peptide consisting of SEQ ID NO: 2. In some embodiments, a detectable bioluminescent signal is produced when the polypeptide contacts a peptide having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 2. In some embodiments, the polypeptide exhibits alteration (e.g., enhancement) of one or more traits compared to a peptide of SEQ ID NO: 440, wherein the traits are selected from: affinity for the peptide consisting of SEQ ID NO: 2, expression, intracellular solubility, intracellular stability, and bioluminescent activity when combined with the peptide consisting of SEQ ID NO: 2. Although not limited to such sequences, the polypeptide amino acid sequence may be selected from one of the amino acid sequences of SEQ ID NOS: 441-2156. In some embodiments, the detectable bioluminescent signal is produced when the polypeptide associates with the peptide consisting of SEQ ID NO: 2. In some embodiments, a fusion polypeptide is provided that comprises: (a) a polypeptide described above and (b) a first interaction polypeptide that forms a complex with a second interaction polypeptide upon contact of the first interaction polypeptide and the second interaction polypeptide. In certain embodiments, a bioluminescent complex is provided that comprises: (a) a first fusion polypeptide described above; and (b) a second fusion polypeptide comprising: (i) the second interaction polypeptide and (ii) a complement peptide that causes the polypeptide comprising an amino acid sequence having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 440 to emit a detectable bioluminescent signal when an association is formed between the two; wherein the first fusion polypeptide and second fusion polypeptide are associated; and wherein the polypeptide comprising an amino acid sequence having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 440 and the complement peptide are associated.

In some embodiments, the present invention provides nucleic acids (e.g., DNA, RNA, etc.), oligonucleotides, vectors, etc., that code for any of the peptides, polypeptides, fusion proteins, etc., described herein. In some embodiments, a nucleic acid comprising or consisting of one of the nucleic acid sequences of SEQ ID NOS: 3-438 and 2162-2365 (coding for non-luminescent peptides) and/or SEQ ID NOS 441-2156 (coding for non-luminescent polypeptides) are provided. In some embodiments, other nucleic acid sequences coding for amino acid sequences of SEQ ID NOS: 3-438 and 2162-2365 and/or SEQ ID NOS 441-2156 are provided.

In certain embodiments, the present invention provides bioluminescent complexes comprising: (a) a peptide comprising a peptide amino acid sequence having less than 100% sequence identity (e.g., >99%, <95%, <90%, <80%, <70%, <60%, <50%, etc.) with SEQ ID NO: 2; and (b) a polypeptide comprising a polypeptide amino acid sequence having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 440, wherein the bioluminescent complex exhibits detectable luminescence. In certain embodiments, the present invention provides bioluminescent complexes comprising: (a) a peptide comprising a peptide amino acid sequence having less than 100% and greater than 40% (e.g., >40%, >45%, >50%, >55%, >60%, >65%, >70%, >75%, >80%, >85%, >90%, >95%, >98%, >99%) sequence identity with SEQ ID NO: 2; and (b) a polypeptide comprising a polypeptide amino acid sequence having less than 100% and greater than 40% (e.g., >40%, >45%, >50%, >55%, >60%, >65%, >70%, >75%, >80%, >85%, >990%, >95%, >98%, >99%) sequence identity with SEQ ID NO: 440, wherein the bioluminescent complex exhibits detectable luminescence. Although not limited to particular sequences, in some embodiments, the peptide amino acid sequence is selected from one of the amino acid sequences provided in SEQ ID NOS: 3-438 and 2162-2365.

In various embodiments, bioluminescent complexes are provided that comprise: (a) a first amino acid sequence that is not a fragment of a preexisting protein; and (b) a second amino acid sequence that is not a fragment of a preexisting protein, wherein the bioluminescent complex exhibits detectable luminescence, wherein the first amino acid sequence and the second amino acid sequence are associated. Some such bioluminescent complexes further comprise: (c) a third amino acid sequence comprising a first member of an interaction pair, wherein the third amino acid sequence is covalently attached to the first amino acid sequence; and (d) a fourth amino acid sequence comprising a second member of an interaction pair, wherein the fourth amino acid sequence is covalently attached to the second amino acid sequence. In certain embodiments, interactions (e.g., non-covalent interactions (e.g., hydrogen bonds, ionic bonds, van der Waals forces, hydrophobic interactions, etc.) covalent interactions (e.g., disulfide bonds), etc.) between the first amino acid sequence and the second amino acid sequence do not significantly associate the first amino acid sequence and the second amino acid sequence in the absence of the interactions between the first member and the second member of the interaction pair. In some embodiments, a first polypeptide chain comprises the first amino acid sequence and the third amino acid sequence, and wherein a second polypeptide chain comprises the second amino acid sequence and the fourth amino acid sequence. In some embodiments, the first polypeptide chain and the second polypeptide chain are expressed within a cell.

In some embodiments, the present invention provides a bioluminescent complex comprising: (a) a pair of non-luminescent elements, wherein each non-luminescent element is not a fragment of a preexisting protein; (b) an interaction pair, wherein each interaction element of the interaction pair is covalently attached to one of the non-luminescent elements.

Various embodiments described herein provide methods of detecting an interaction between a first amino acid sequence and a second amino acid sequence comprising, for example, the steps of: (a) attaching the first amino acid sequence to a third amino acid sequence and attaching the second amino acid sequence to a fourth amino acid sequence, wherein the third and fourth amino acid sequences are not fragments of a preexisting protein, wherein a complex of the third and fourth amino acid sequences emits a detectable bioluminescent signal (e.g., substantially increased bioluminescence relative to the polypeptide chains separately), wherein the interactions (e.g., non-covalent) between the third and fourth amino acid sequences are insufficient to form, or only weakly form, a complex of the third and fourth amino acid sequences in the absence of additional stabilizing and/or aggregating conditions, and wherein a interaction between the first amino acid sequence and the second amino acid sequence provides the additional stabilizing and/or aggregating forces to produce a complex of the third and fourth amino acid sequences: (b) placing the first, second, third, and fourth amino acid sequences of step (a) in conditions to allow for interactions between the first amino acid sequence and the second amino acid sequence to occur; and (c) detecting the bioluminescent signal emitted by the complex of the third and fourth amino acid sequences, wherein detection of the bioluminescent signal indicates an interaction between the first amino acid sequence and the second amino acid sequence. In some embodiments, attaching the first amino acid sequence to the third amino acid sequence and the second amino acid sequence to the fourth amino acid sequence comprises forming a first fusion protein comprising the first amino acid sequence and the third amino acid sequence and forming a second fusion protein comprising the second amino acid sequence and the fourth amino acid sequence. In some embodiments, the first fusion protein and the second fusion protein further comprise linkers between said first and third amino acid sequences and said second and fourth amino acid sequences, respectively. In certain embodiments, the first fusion protein is expressed from a first nucleic acid sequence coding for the first and third amino acid sequences, and the second fusion protein is expressed from a second nucleic acid sequence coding for the second and fourth amino acid sequences. In some embodiments, a single vector comprises the first nucleic acid sequence and the second nucleic acid sequence. In other embodiments, the first nucleic acid sequence and the second nucleic acid sequence are on separate vectors. In certain embodiments, the steps of (a) "attaching" and (b) "placing" comprise expressing the first and second fusion proteins within a cell.

Provided herein are methods of creating, producing, generating, and/or optimizing a pair of non-luminescent elements comprising: (a) aligning the sequences of three or more related proteins: (b) determining a consensus sequence for the related proteins; (c) providing first and second fragments of a protein related to three or more proteins (or providing first and second fragments of one of the three or more proteins), wherein the fragments are individually substantially non-luminescent but exhibit luminescence upon interaction of the fragments; (d) mutating the first and second fragments at one or more positions each, wherein the mutations alter the sequences of the fragments to be more similar to a corresponding portion of the consensus sequence (e.g., wherein the mutating results in a pair of non-luminescent elements that are not fragments of a preexisting protein), and (e) testing the pair of non-luminescent elements for the absence (e.g., essential absence, substantial absence, etc.) of luminescence when unassociated, and luminescence upon association of the non-luminescent pair into a bioluminescent complex. Examples of such a process are described in Examples 1-5. In some embodiments, the non-luminescent elements exhibit enhancement of one or more traits compared to the first and second fragments, wherein the traits are selected from: increased reconstitution affinity, decreased reconstitution affinity, enhanced expression, increased intracellular solubility, increased intracellular stability, and increased intensity of reconstituted luminescence.

In some embodiments, the present invention provides detection reagents comprising: (a) a polypeptide comprising an amino acid sequence having less than 100% and greater than 40% sequence identity with SEQ ID NO: 440, wherein a detectable bioluminescent signal is produced when the polypeptide contacts a peptide consisting of SEQ ID NO: 2, and (b) a substrate for a bioluminescent complex produced by the polypeptide and a peptide consisting of SEQ ID NO: 2. In some embodiments, the present invention provides detection reagents comprising: (a) a peptide comprising an amino acid sequence having less than 100% sequence identity with SEQ ID NO: 2, wherein a detectable bioluminescent signal is produced when the peptide contacts a polypeptide consisting of SEQ ID NO: 440, and (b) a substrate for a bioluminescent complex produced by the peptide and a polypeptide consisting of SEQ ID NO: 440. In some embodiments, the present invention provides detection reagents comprising: (a) a peptide comprising an amino acid sequence having less than 100% and greater than 40% sequence identity with SEQ ID NO: 2, wherein a detectable bioluminescent signal is produced when the peptide contacts a polypeptide consisting of SEQ ID NO: 440, and (b) a substrate for a bioluminescent complex produced by the peptide and a polypeptide consisting of SEQ ID NO: 440.

BRIEF DESCRIPTION OF THE DRAWINGS

FIG. 10 shows a graph of the luminescence of various mutations of residue R11 of NLpoly-5A2 in the presence of NLpep53 (top) and in the absence of complimentary peptide (bottom).

FIG. 13 shows a graph of the luminescence of various mutations of residue F31 of NLpoly 5A2 in the presence of NLpep53 (top) and in the absence of complimentary peptide (bottom).

FIG. 15 shows a graph of the luminescence of various mutations of residue A67 of NLpoly 5A2 in the presence of NLpep53 (top) and in the absence of complimentary peptide (bottom).

FIG. 16 shows a graph of the luminescence of various mutations of residue M 106 of NLpoly 5A2 in the presence of NLpep53 (top) and in the absence of complimentary peptide (bottom).

FIG. 17 shows a graph of the luminescence of various mutations of residue L149 of NLpoly 5A2 in the presence of NLpep53 (top) and in the absence of complimentary peptide (bottom).

FIG. 18 shows a graph of the luminescence of various mutations of residue V 157 of NLpoly 5A2 in the presence of NLpep53 (top) and in the absence of complimentary peptide (bottom).

FIG. 24 shows a graph of the luminescence of NLpolys 1-13 with NLpep53 (top) and without complimentary peptide (bottom).

Figure 88:
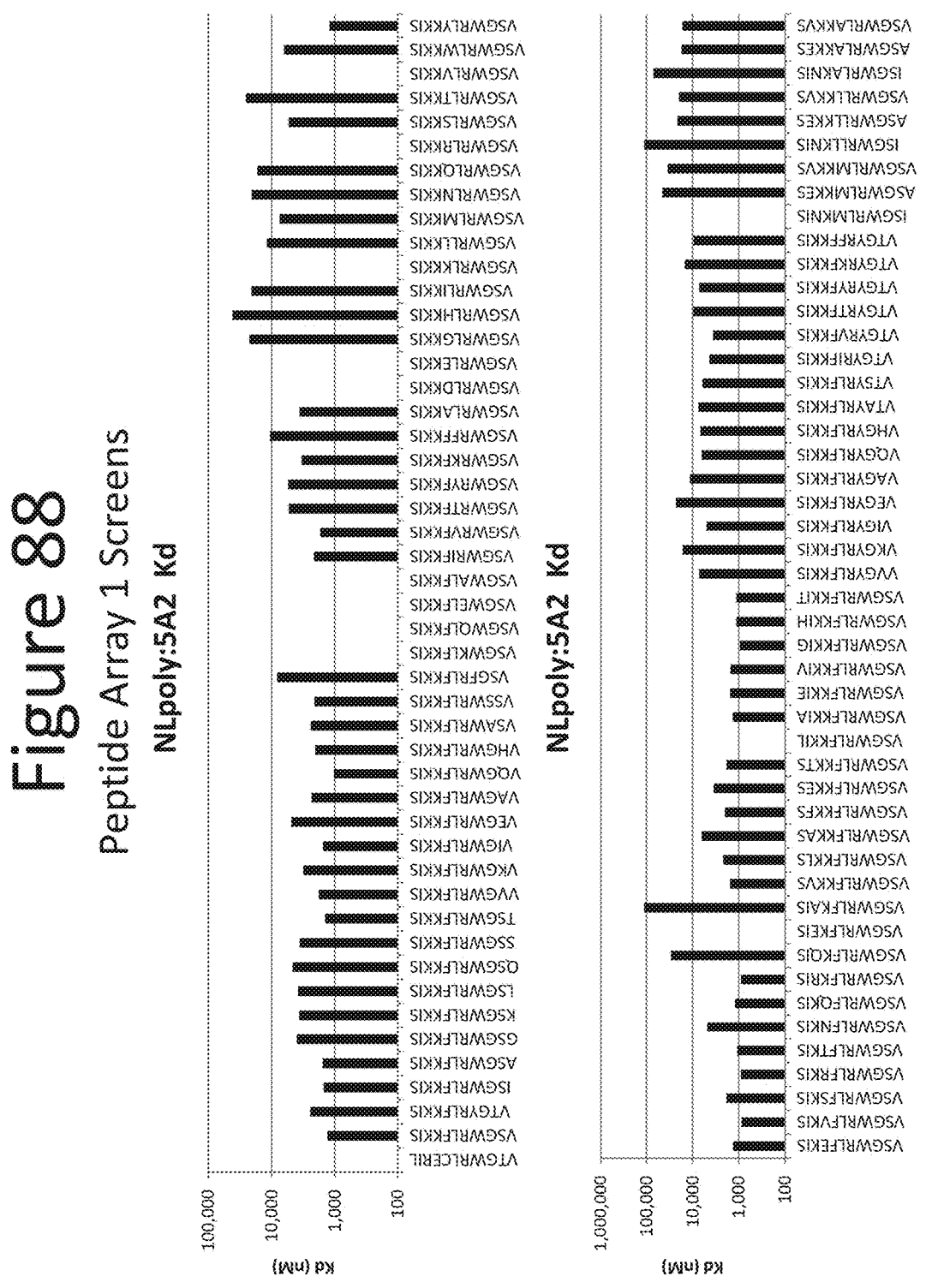

FIG. 83-90 show the dissociation constants as well as the Vmax values for NLpoly 5A2, 5P, 8S and 11S with 96 variants of NLpeps. The upper graphs show the values for SEQ ID Nos: 2366-2413. The lower graphs show the values for SEQ ID NOs: 2414-2461.

FIG. 95 contains a table of the association and dissociation rate constants for the binding of NLpoly WT or 11S to NLpepWT, 78 or 79.

FIG. 128 shows a rapamycin time course of cells expressing FRB-NLpoly11S/5A2 and FKBP-NLpep87/101 conducted in the presence or absence of rapamycin wherein the rapamycin was added manually.

FIG. 129 shows a rapamycin time course of cells expressing FRB-NLpoly11S/5A2 and FKBP-NLpep87/101 conducted in the presence or absence of rapamycin wherein the rapamycin was added via instrument injector.

FIG. 130 shows luminescence generated by FRB-NLpoly11S and FKBP-NLpep 101 as measured on two different luminescence-reading instruments.

Figure 131:
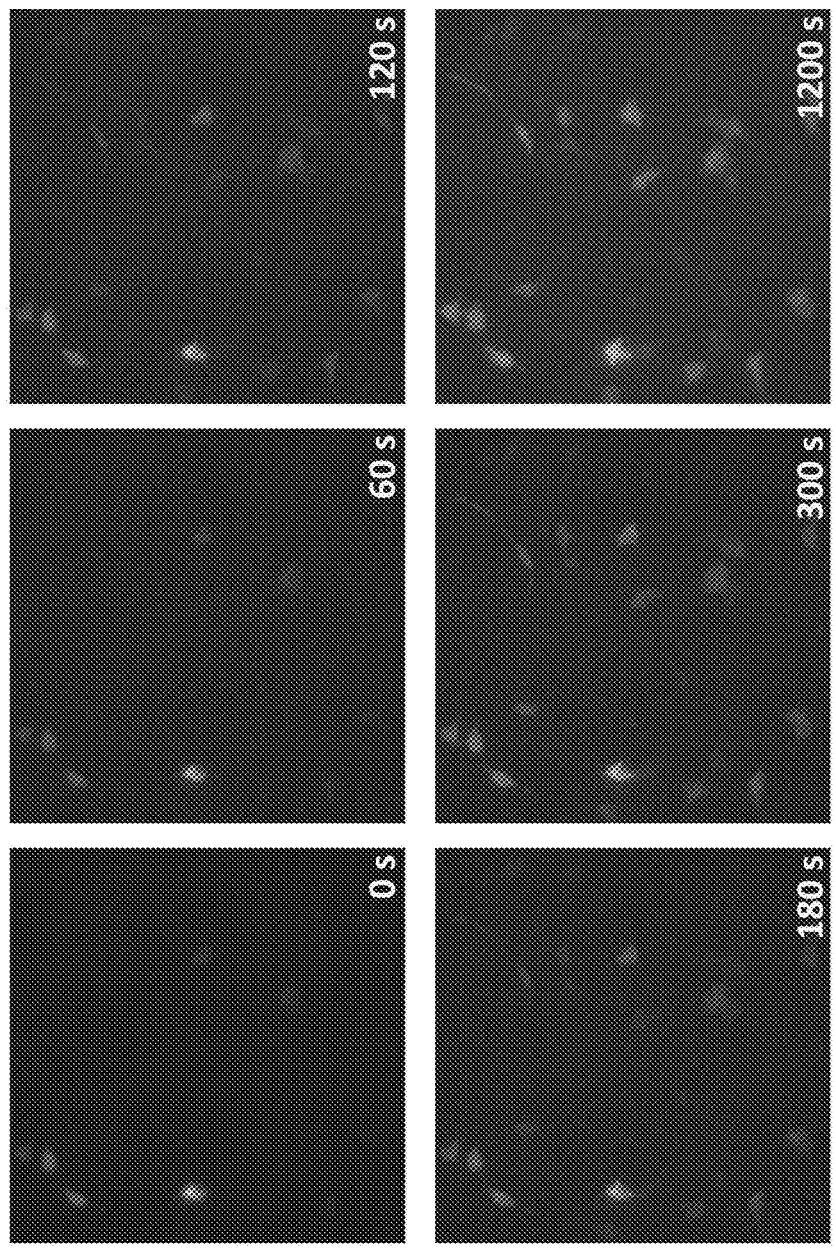

FIG. 131 provides images showing luminescence of cells expressing FRB-NLpoly11S and FKBP-NLpep101 at various times after treatment with rapamycin.

Figure 132:
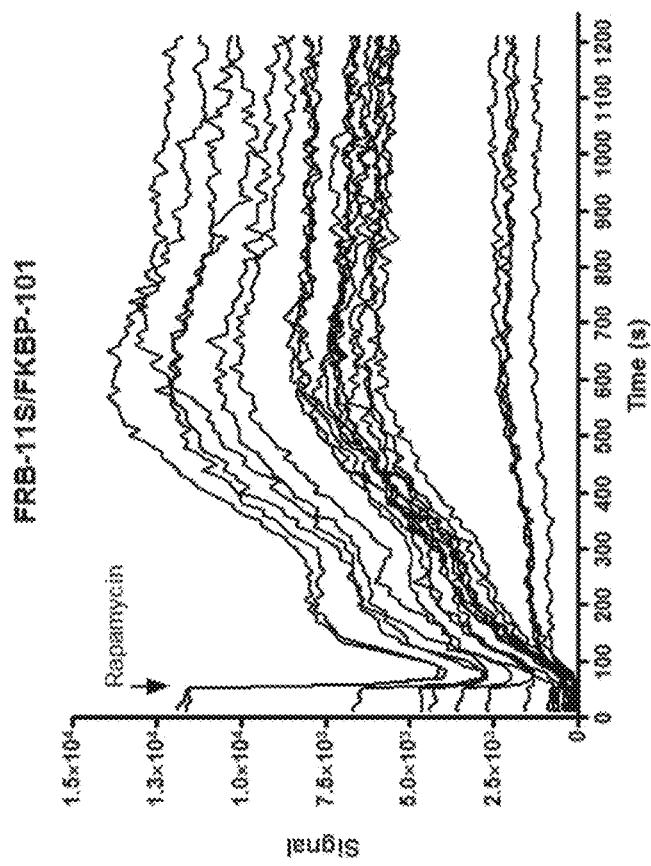

FIG. 132 provides a graph showing Image J quantitation of the signal generated by individual cells expressing FRB-NLpoly11S and FKBP-NLpep101 at various times after treatment with rapamycin.

Figure 133:
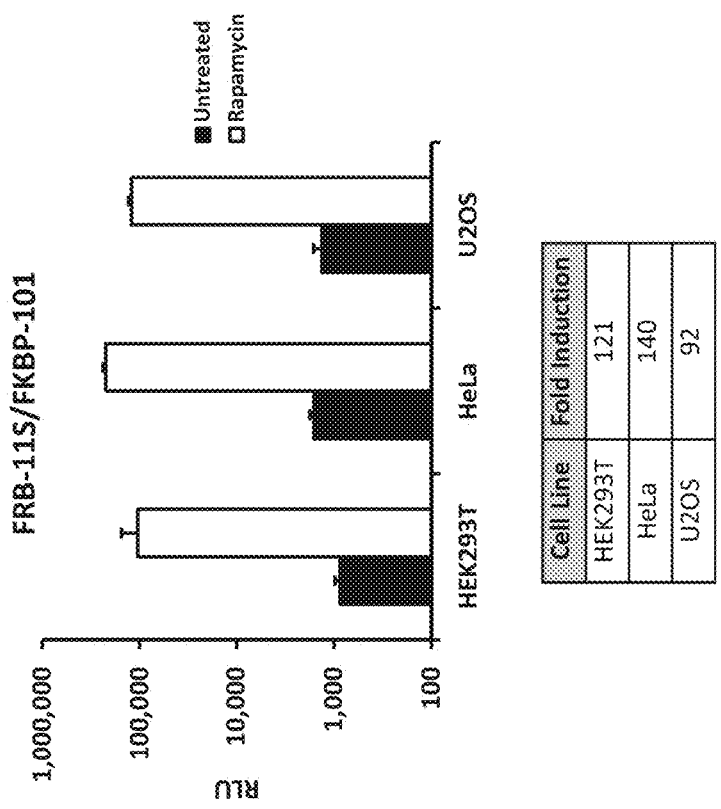

FIG. 133 shows a comparison of luminescence in different cell lines expressing FRB-NLpoly11S and FKBP-NLpep101.

Figure 134:
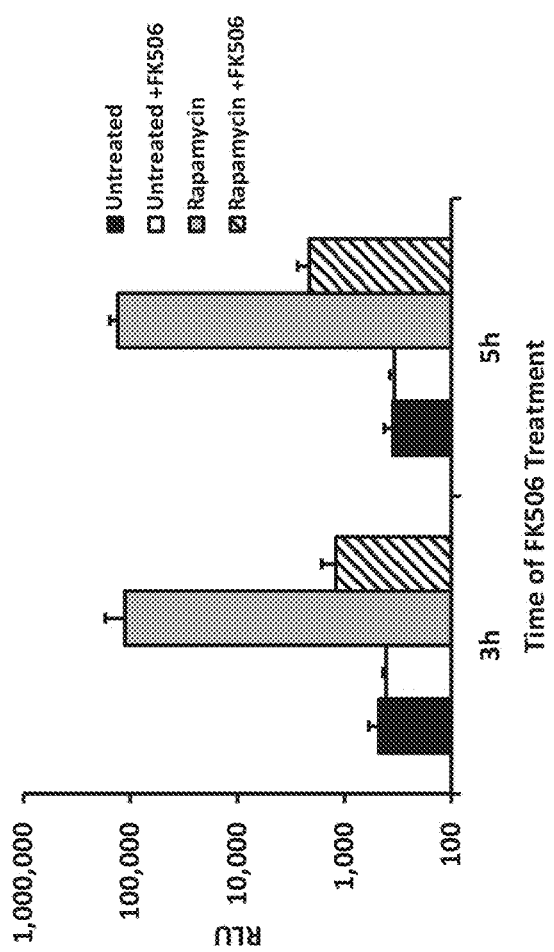

FIG. 134 shows a comparison of luminescence generated by cells expressing FRB-NLpoly11S and FKBP-NLpep101 after treatment with the rapamycin competitive inhibitor FK506.

Figure 135:
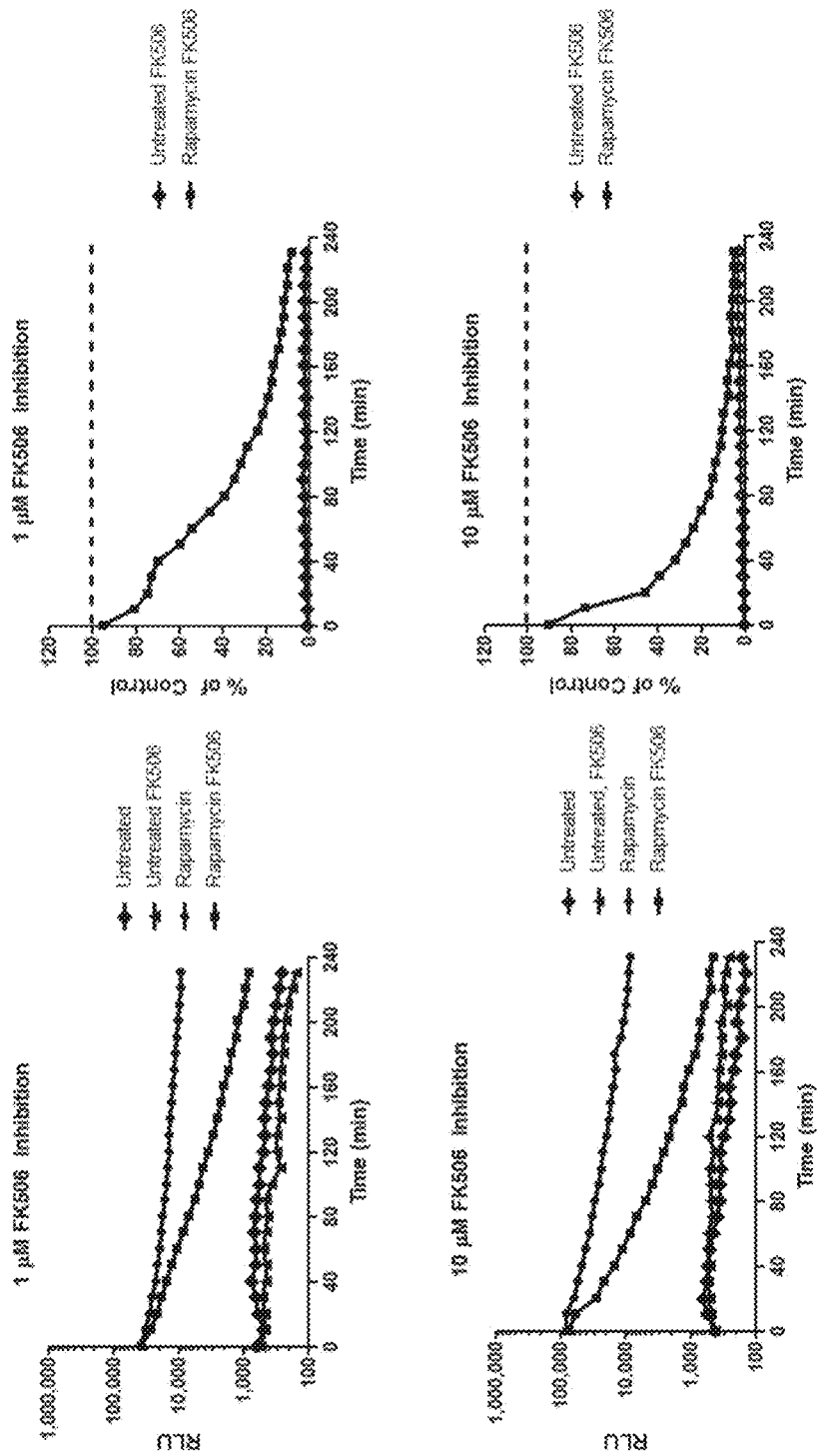

FIG. 135 shows (left side) luminescence generated by cells expressing FRB-NLpoly11S and FKBP-NLpep101 after treatment with the rapamycin competitive inhibitor FK506, and (right side) the percent of luminescence remaining after treatment with FK506.

Figure 136:
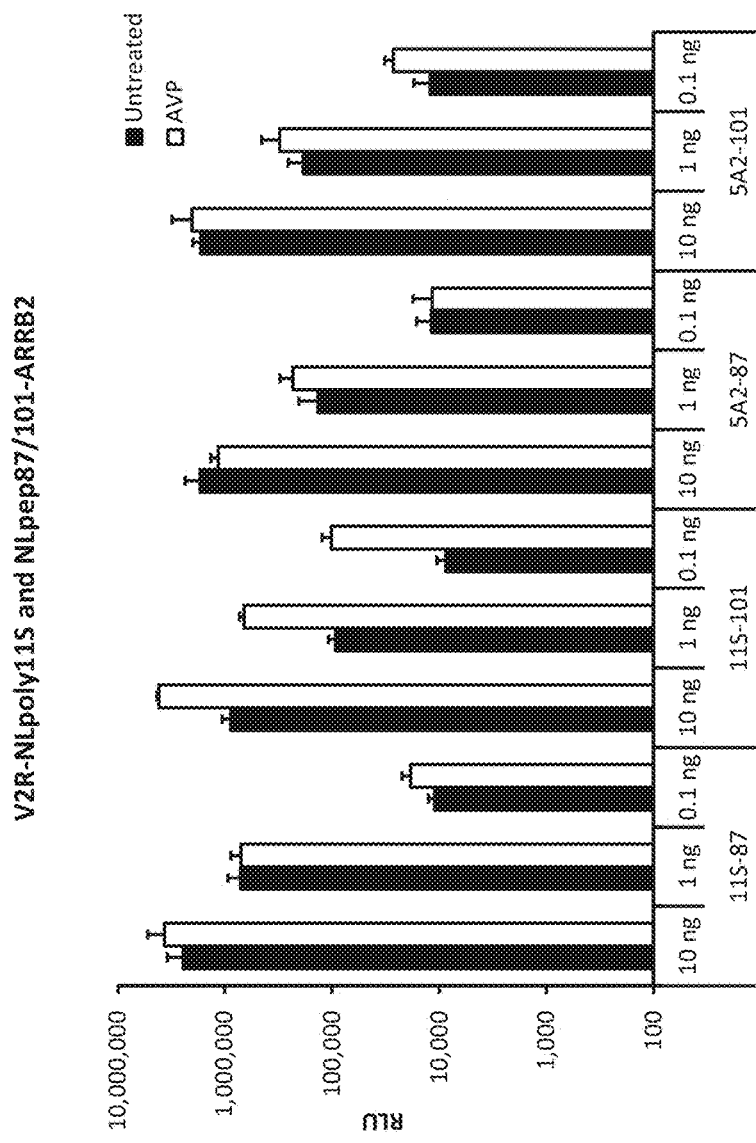

FIG. 136 shows luminescence generated by cells transfected with different combinations of V2R-NLpoly5A2 or V2R-NLpoly11S with NLpep87/101-ARRB2 in the presence or absence of the V2R agonist AVP.

Figure 137:
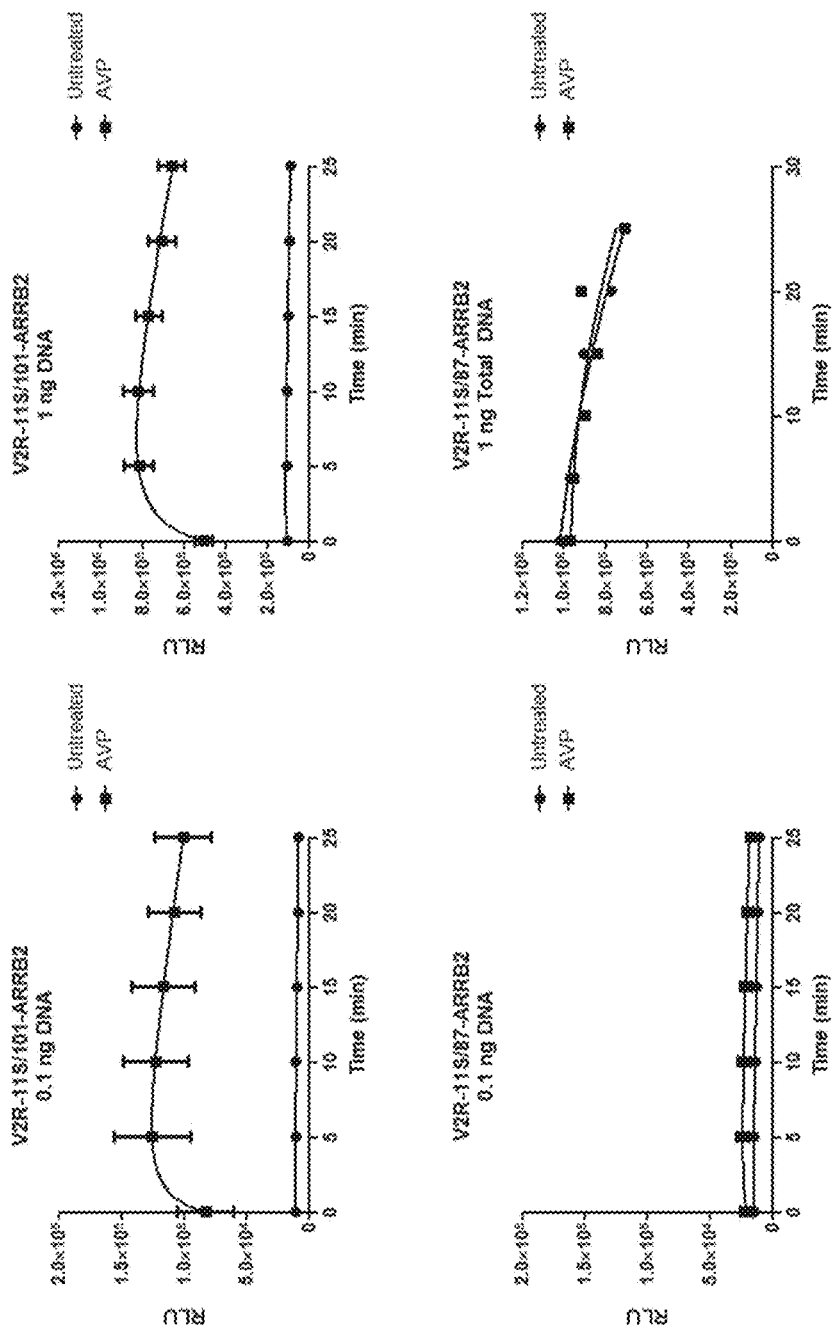

FIG. 137 shows an AVP treatment time course showing luminescence generated by cells transfected with V2R-NLpoly11S and NLpep87/101-ARRB2 after treatment with AVP wherein AVP was added manually.

Figure 138:
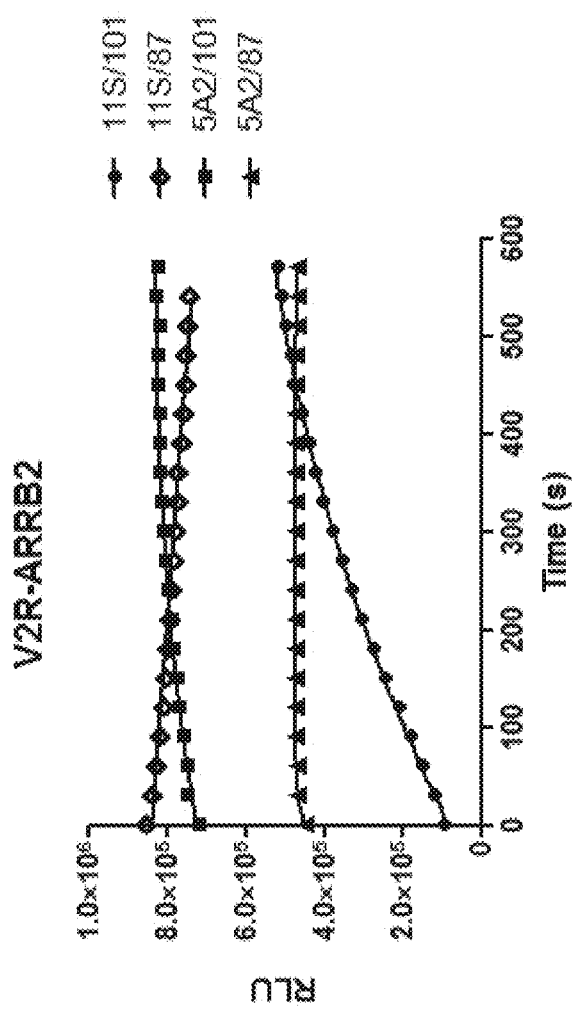

FIG. 138 shows an AVP treatment time course showing luminescence generated by cells transfected with different combinations of V2R-NLpoly5A2 or V2R-NLpoly11S with NLpep87/01-ARRB2 after treatment with AVP wherein AVP was added via instrument injector.

Figure 139:
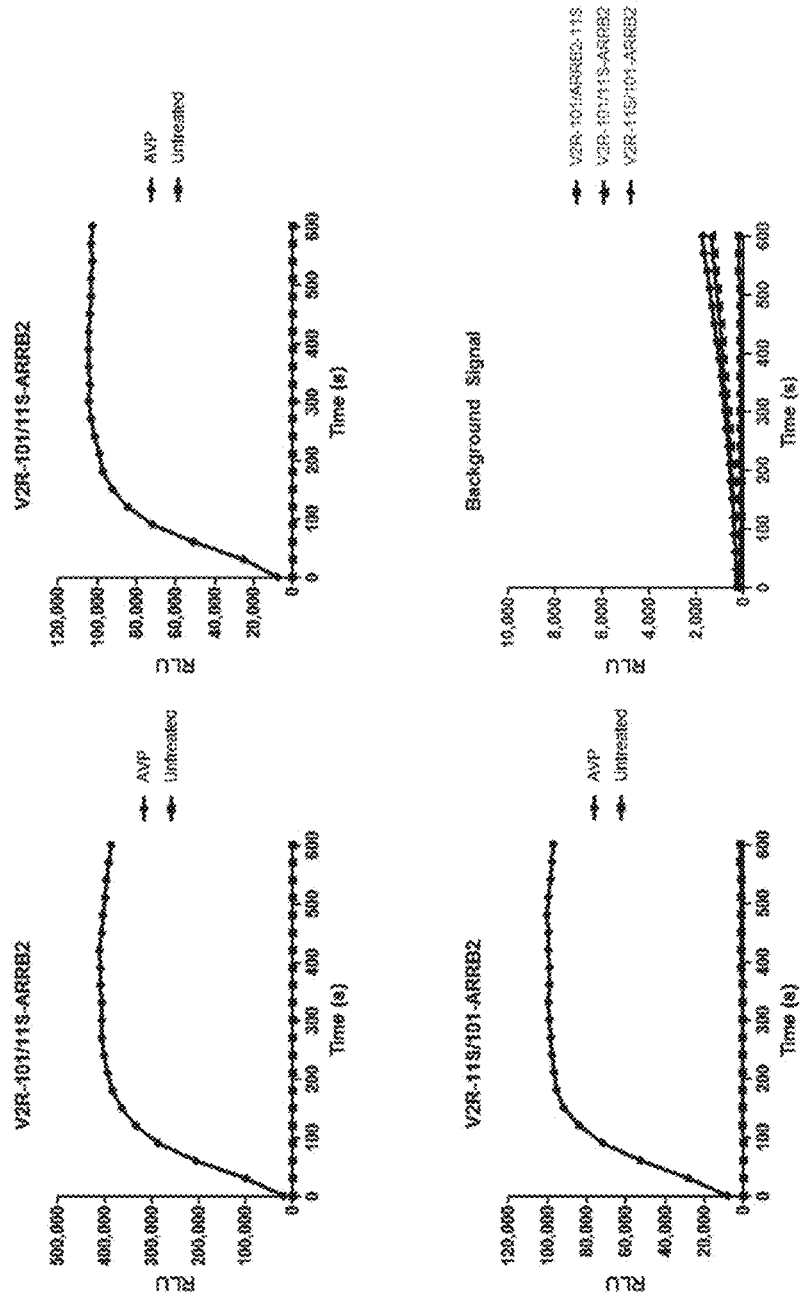

FIG. 139 shows an AVP treatment time course at 37° C. showing luminescence generated by cells expressing different configurations of V2R and ARRB2 fused to NLpoly11S and NLpep101 after treatment with AVP.

Figure 140:
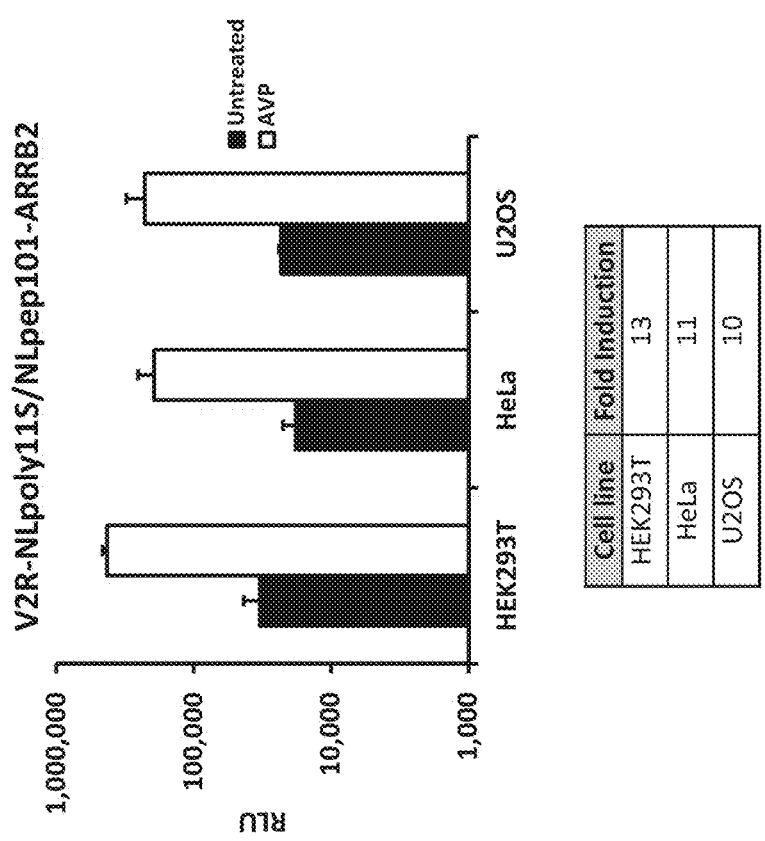

FIG. 140 shows a comparison of luminescence in different cell lines expressing V2R-NLpep 1S and NLpep101l-ARRB2.

Figure 141:
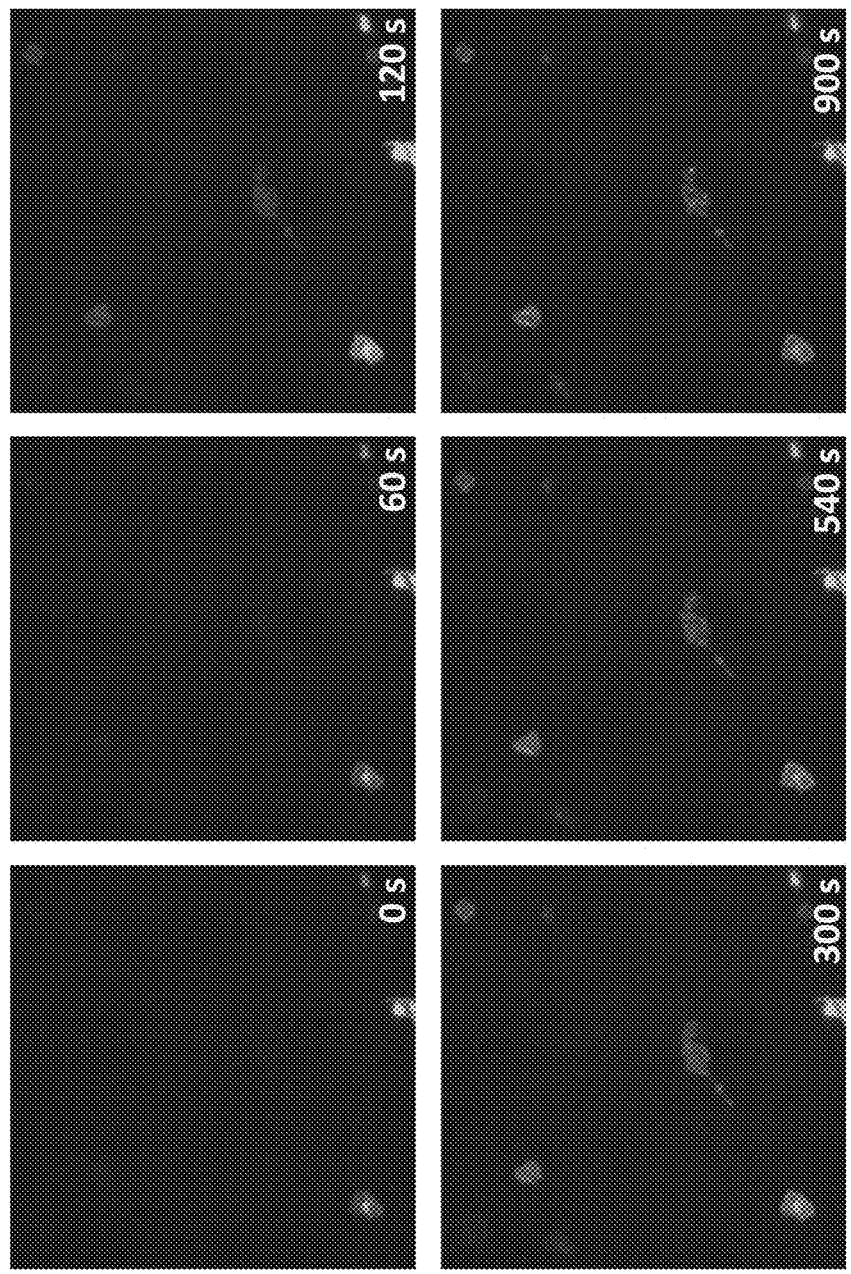

FIG. 141 shows 60× images showing luminescence of cells expressing V2R-NLpoly11S and NLpep101-ARRB2 at various times after treatment with AVP.

Figure 142:
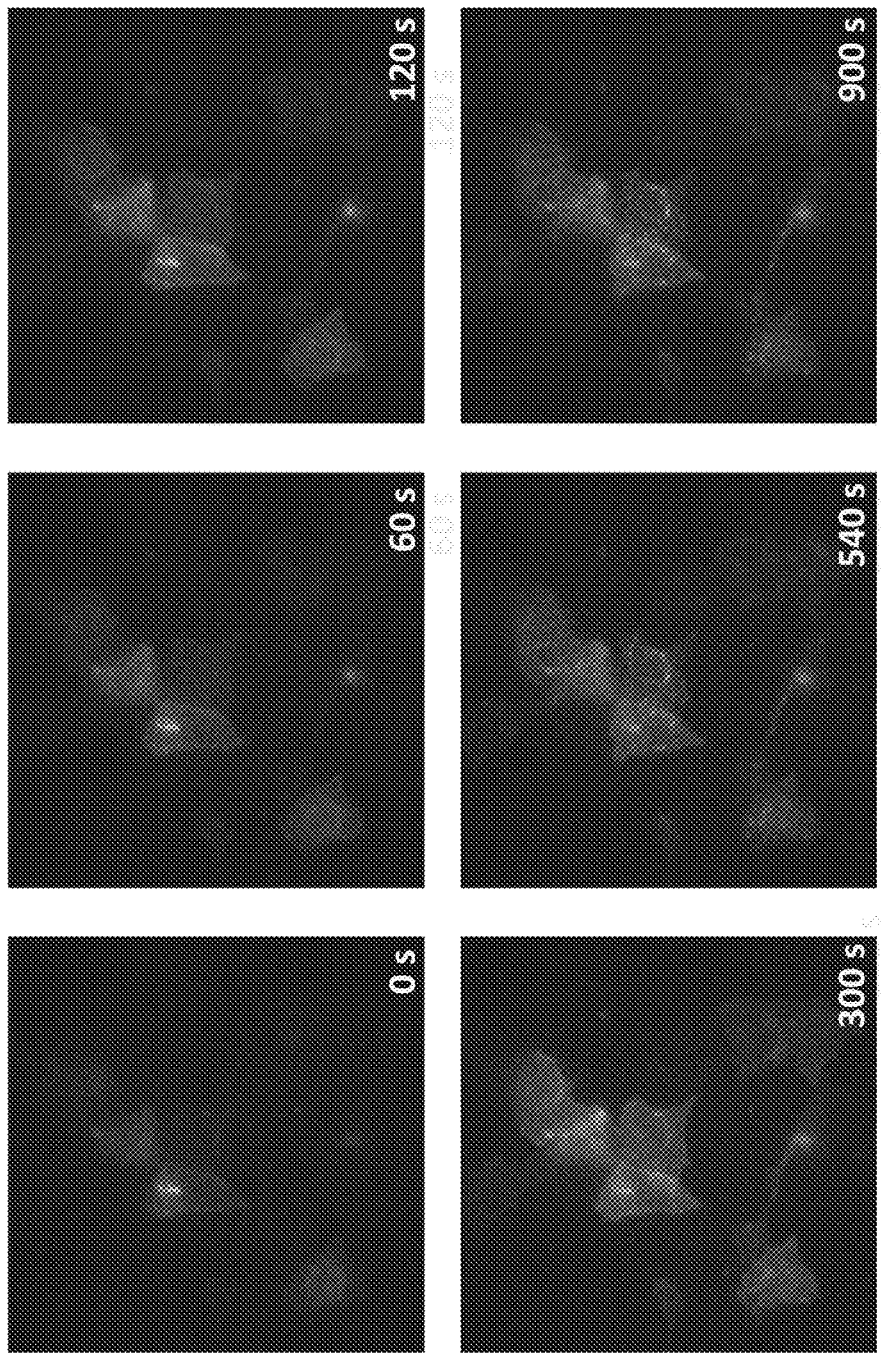

FIG. 142 shows 150× images showing luminescence of cells expressing V2R-NLpoly11S and NLpep101-ARRB2 at various times after treatment with AVP.

Figure 143:
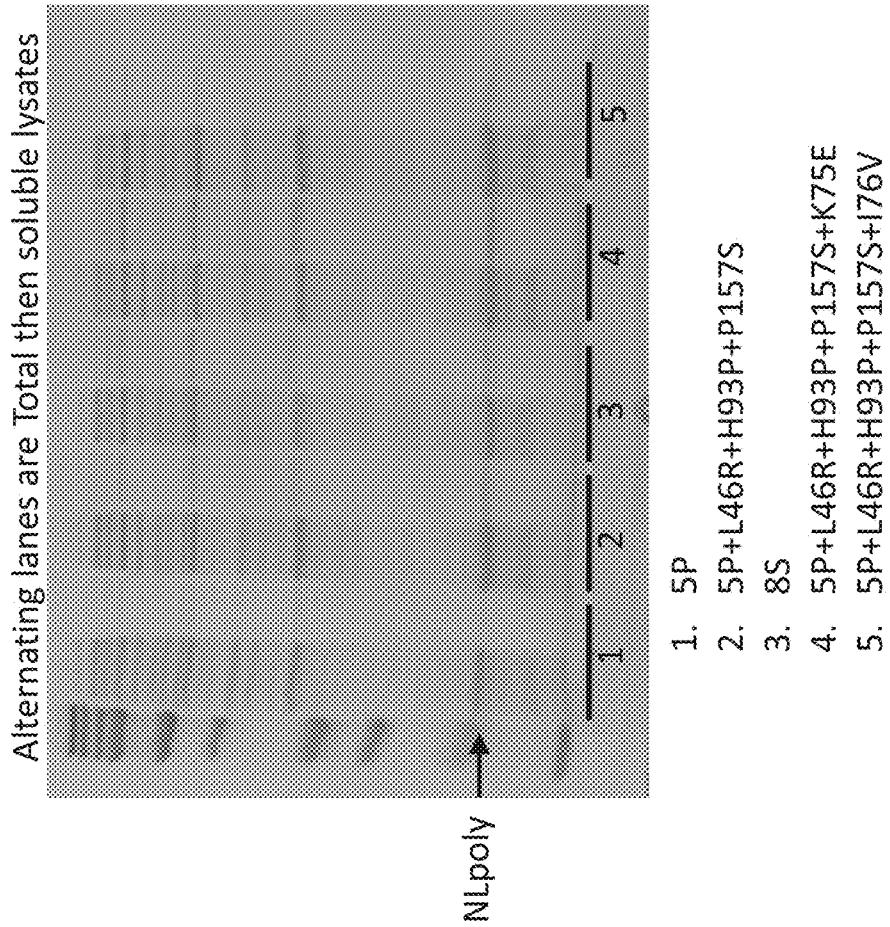

FIG. 143 shows a protein gel of total lysates and the soluble fraction of the same lysate for NLpoly variants.

Figure 144:
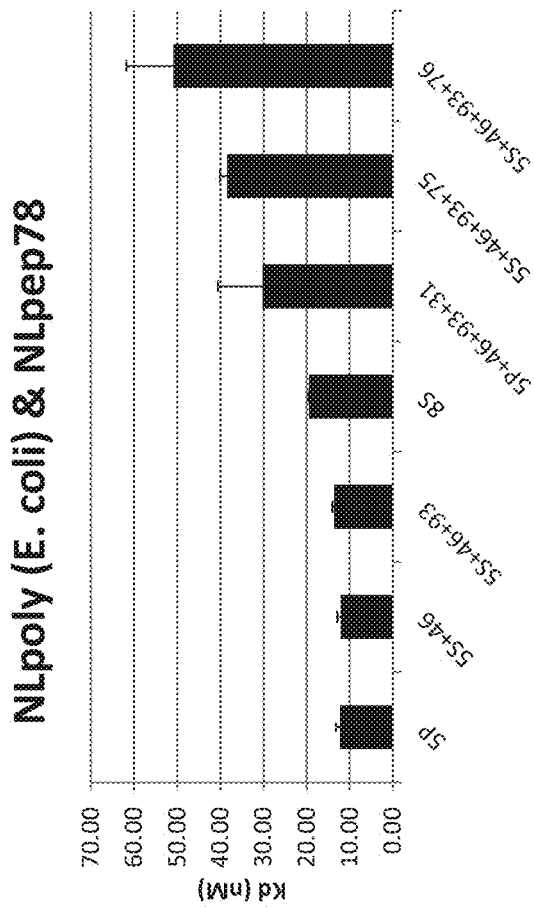

FIG. 144 shows the dissociation constants for NLpoly 5P and combinations of mutations at positions 31, 46, 75, 76, and 93 in NLpoly 5P.

Figure 145:
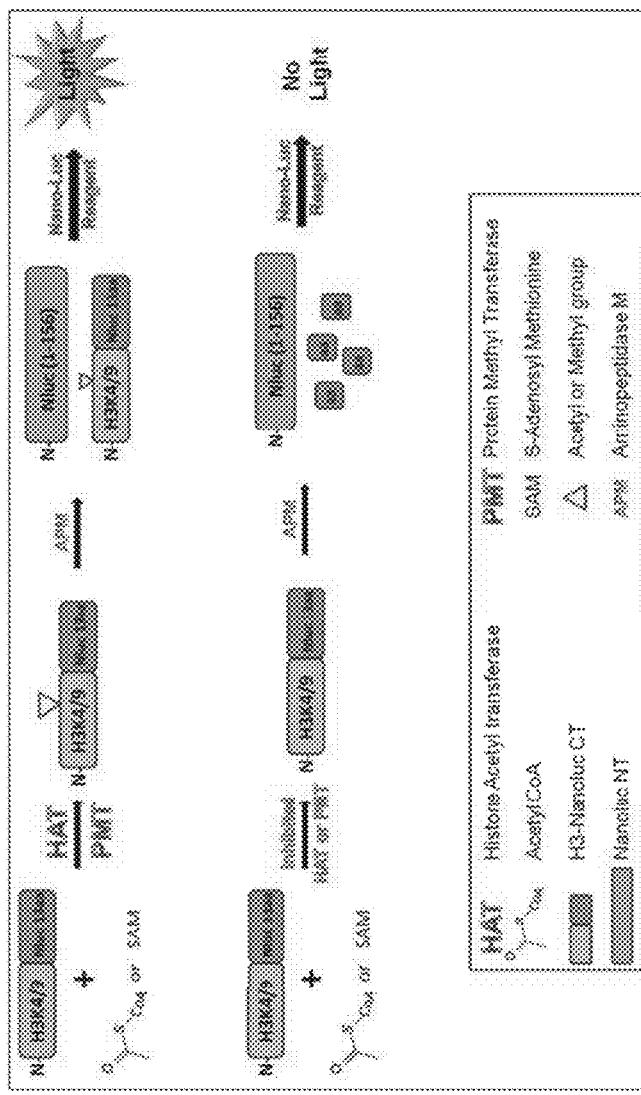

FIG. 145 shows a transferase example of post translational modification enzyme activity detection using an NLpep and aminopeptidase.

Figure 146:
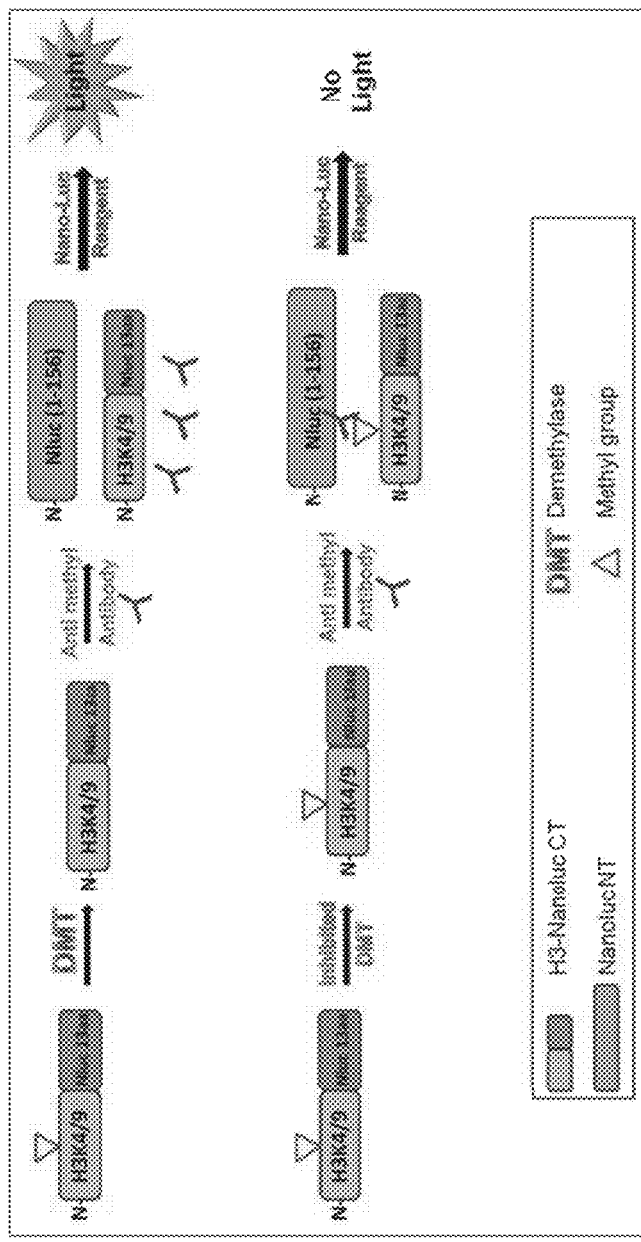

FIG. 146 shows a hydrolase example of post translational modification enzyme activity detection using an NLpep and methyl-specific antibody.

FIG. 147 contains wavelength scans for NLpoly WT complemented with either NLpepWT or NLpepWT conjugated to TMR.

Figure 148:
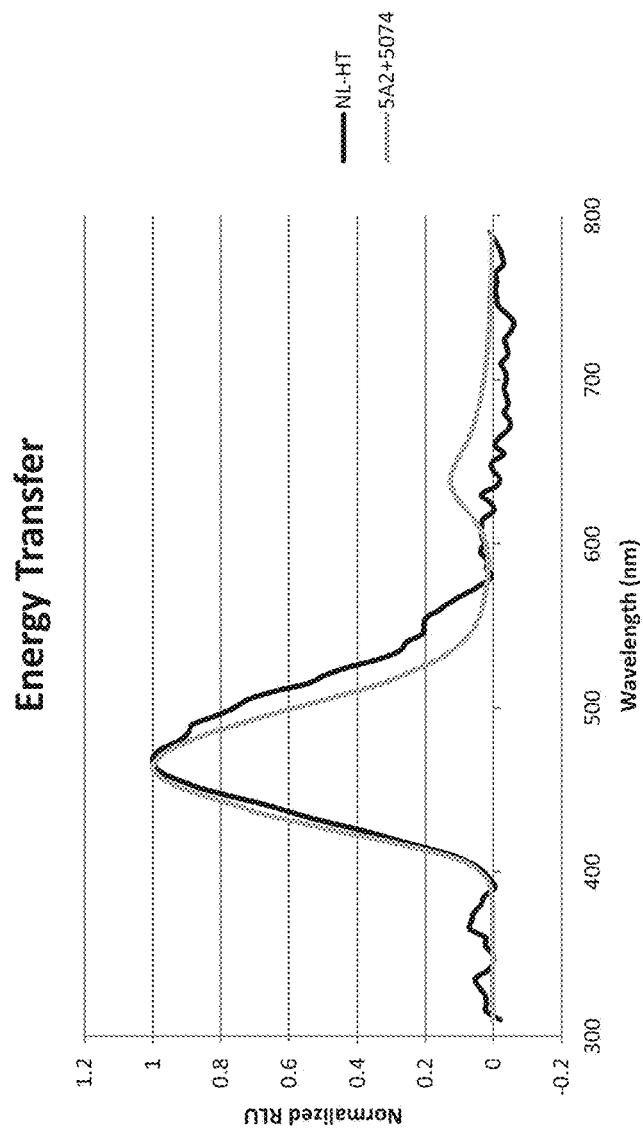

FIG. 148 contains wavelength scans for NANOLUC fused to HALOTAG (NL-HT) and NLpoly 5A2 complemented with NLPepWT with 4 additional amino acids (DEVD) and conjugated to Non-chloroTOM (NCT) (SEQ ID NO: 2579).

Figure 149:
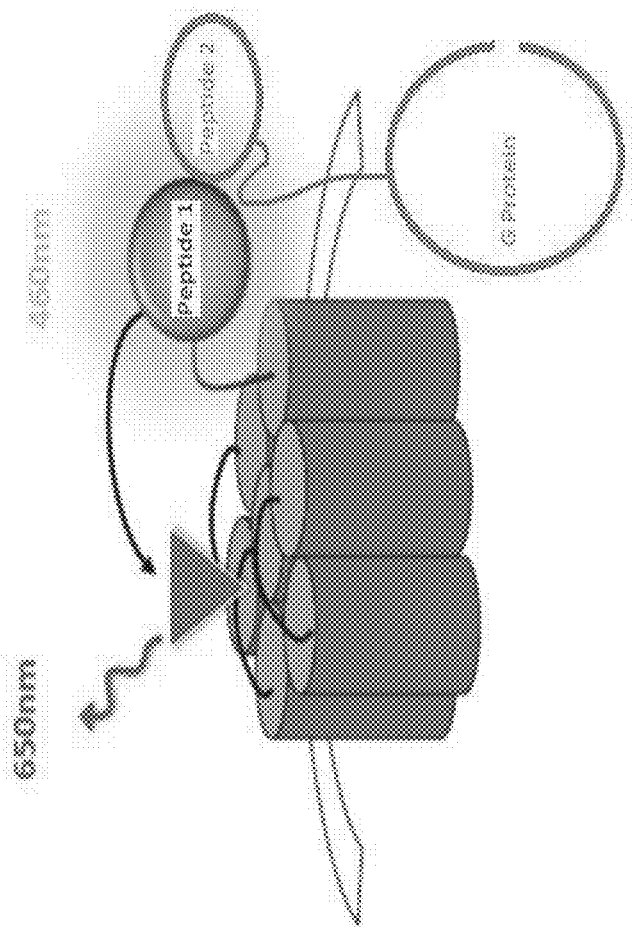

FIG. 149 shows a schematic a tertiary interaction wherein the energy transfer with an NLpoly and NLpep can also be used to measure three molecules interacting. In the schematic, a GPCR labeled with an NLpoly and a GPCR interacting protein labeled with an NLpep form a bioluminescent complex when they interact. This allows measurement of the binary interaction. If a small molecule GPCR ligand bearing an appropriate fluorescent moiety for energy transfer interacts with this system, energy transfer will occur. Therefore, the binary protein-protein interaction and the ternary drug-protein-protein interaction can be measured in the same experiment.

Figure 150:
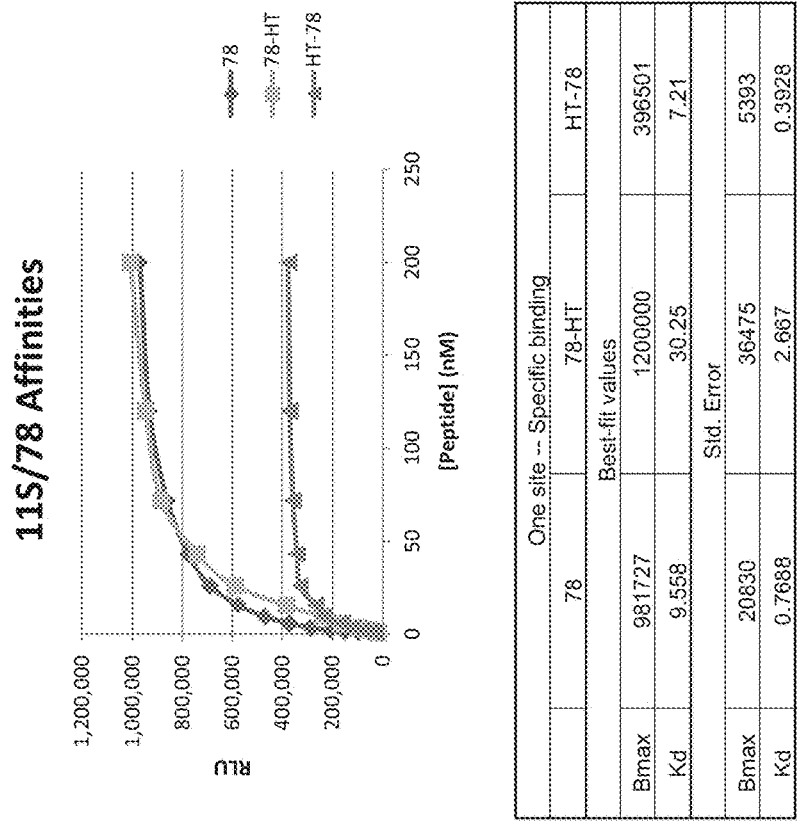

FIG. 150 shows a graph and table of binding affinities of NLpoly11S to synthetic NLpep78 and NLPep78 at the N- or C-terminus of a fusion partner (HALOTAG).

Figure 151:
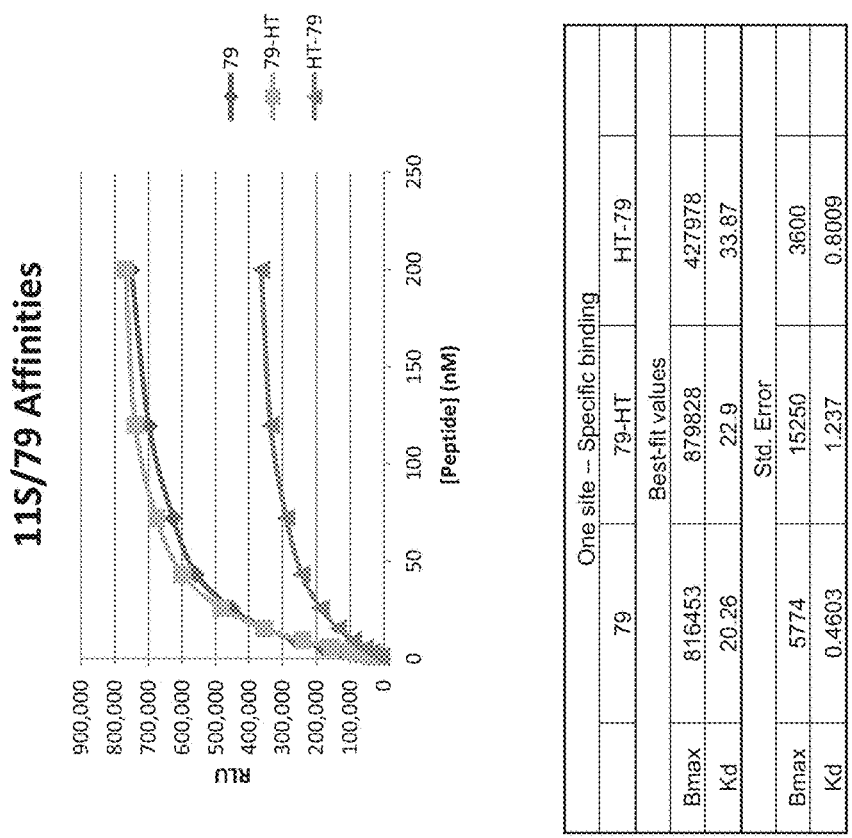

FIG. 151 shows a graph and table of binding affinities of NLpoly11S to synthetic NLpep79 and NLPep79 at the N- or C-terminus of a fusion partner (HALOTAG).

FIG. 152 shows a graph depicting normalized fluorescence intensity of NLpoly11S with NLPep86 or PBI-4877.

FIG. 153 shows a graph depicting normalized fluorescence intensity of NLpoly11S with NLPep86 or PBI-5434.

FIG. 154 shows a graph depicting normalized fluorescence intensity of NLpoly11S with NLPep86 or PBI-5436.

Figure 155:
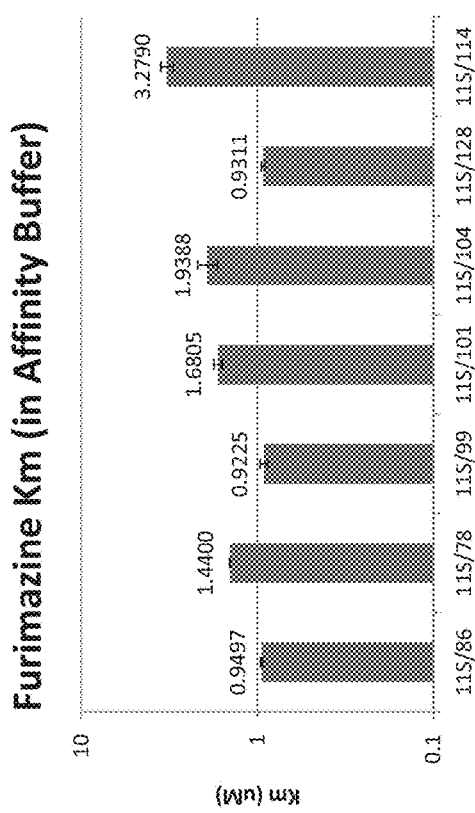

FIG. 155 shows a graph demonstrating furimazine binding affinity in affinity buffer of complexes between NLpoly11S and NLpep86, 78, 99, 101, 104, 128 and 114.

Figure 156:
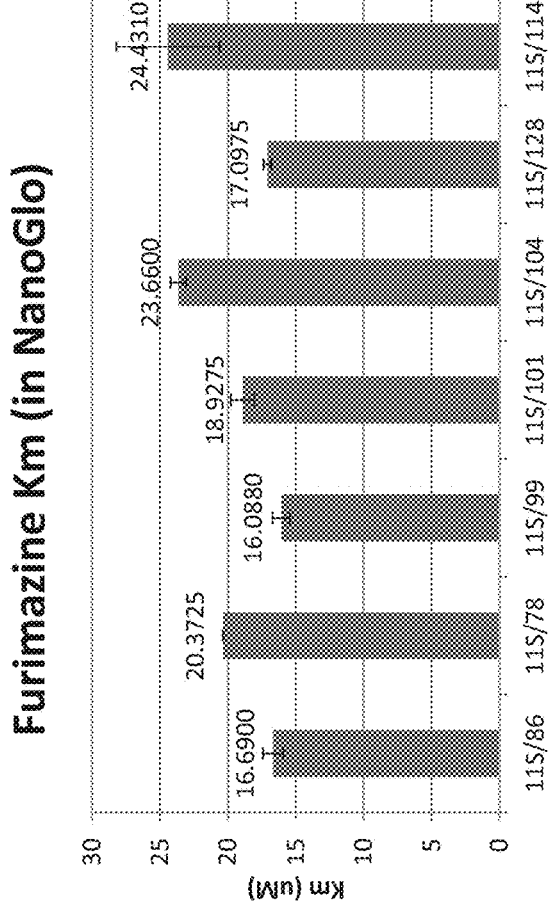

FIG. 156 shows a graph demonstrating furimazine binding affinity in NANOGLO assay buffer of complexes between NLpoly11S and NLpep86, 78, 99, 101, 104, 128 and 114.

FIG. 157 shows graphs depicting the change in affinity (NLpoly156/NLPep1 and NLpoly11S/NLPep1) with increasing concentrations of furimazine substrate.

Figure 158:
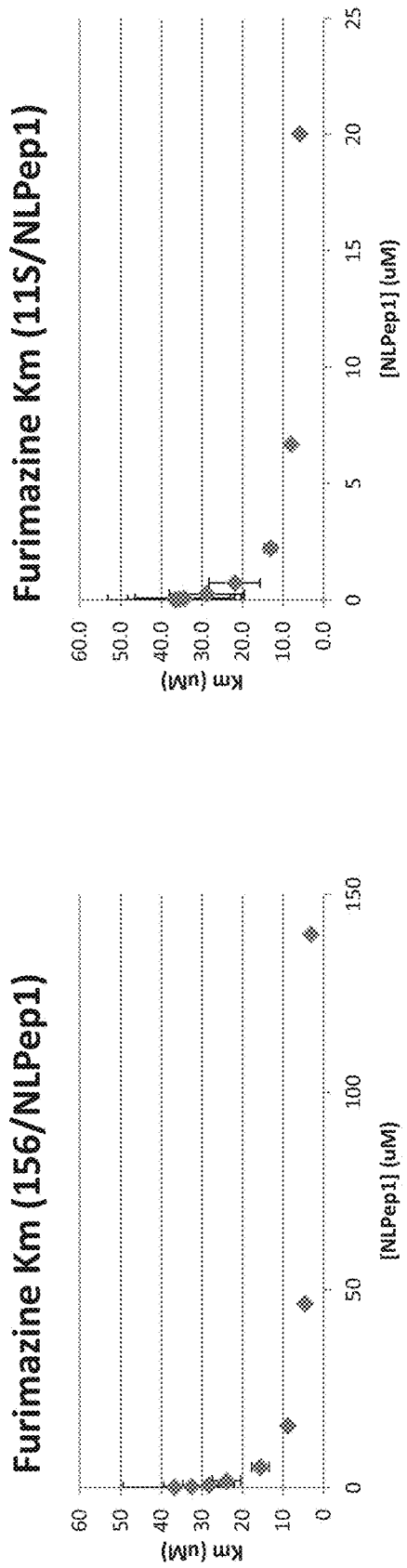

FIG. 158 shows graphs depicting the change in affinity (NLpoly156/NLPep1 and NLpoly11S/NLPep1) with increasing concentrations of NLPep1.

Figure 159:
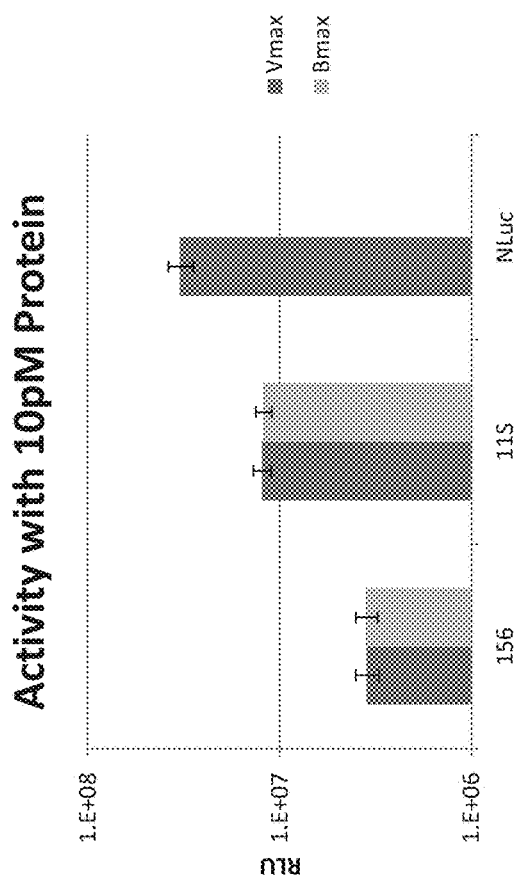

FIG. 159 shows a graph depicting Vmax and Bmax NLPoly156, NLPoly11S. and NANOLUC luciferase (Nluc) with NLPep1.

Figure 160:
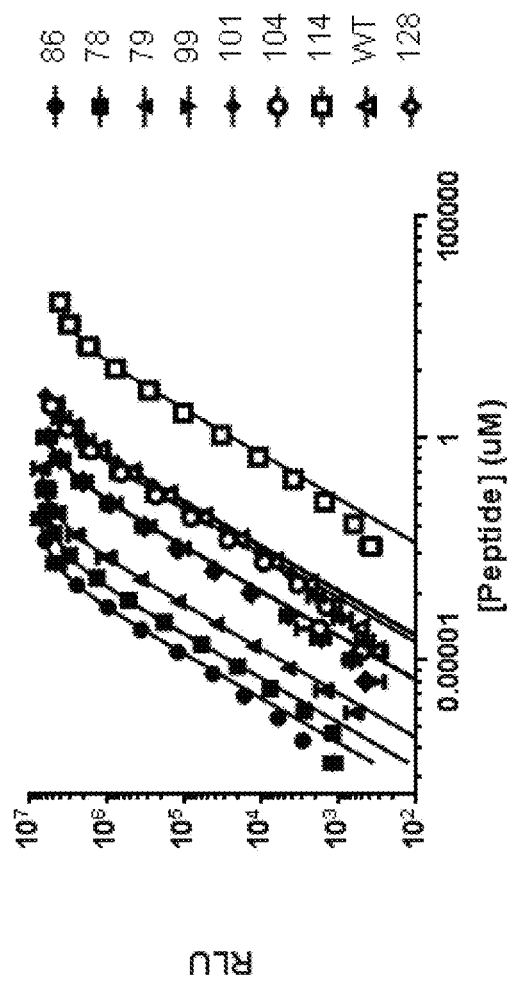

FIG. 160 shows a graph depicting RLU as a function of NLPep concentration for NLPoly11S and NLPep86, 78, 79, 99, 101, 104, 114, 128 and wt.

Figure 161:
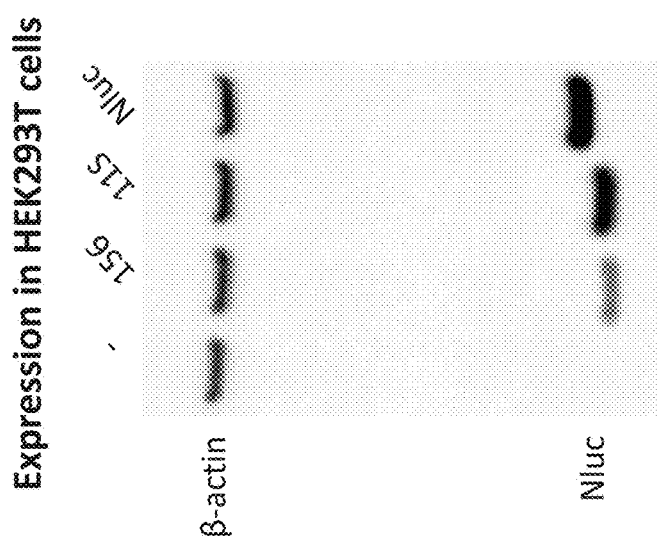

FIG. 161 shows a Western blot depicting expression level in HEK293T cells of NLPoly156 and NLPoly11S compared to full-length NANOLUC luciferase.

Figure 162:
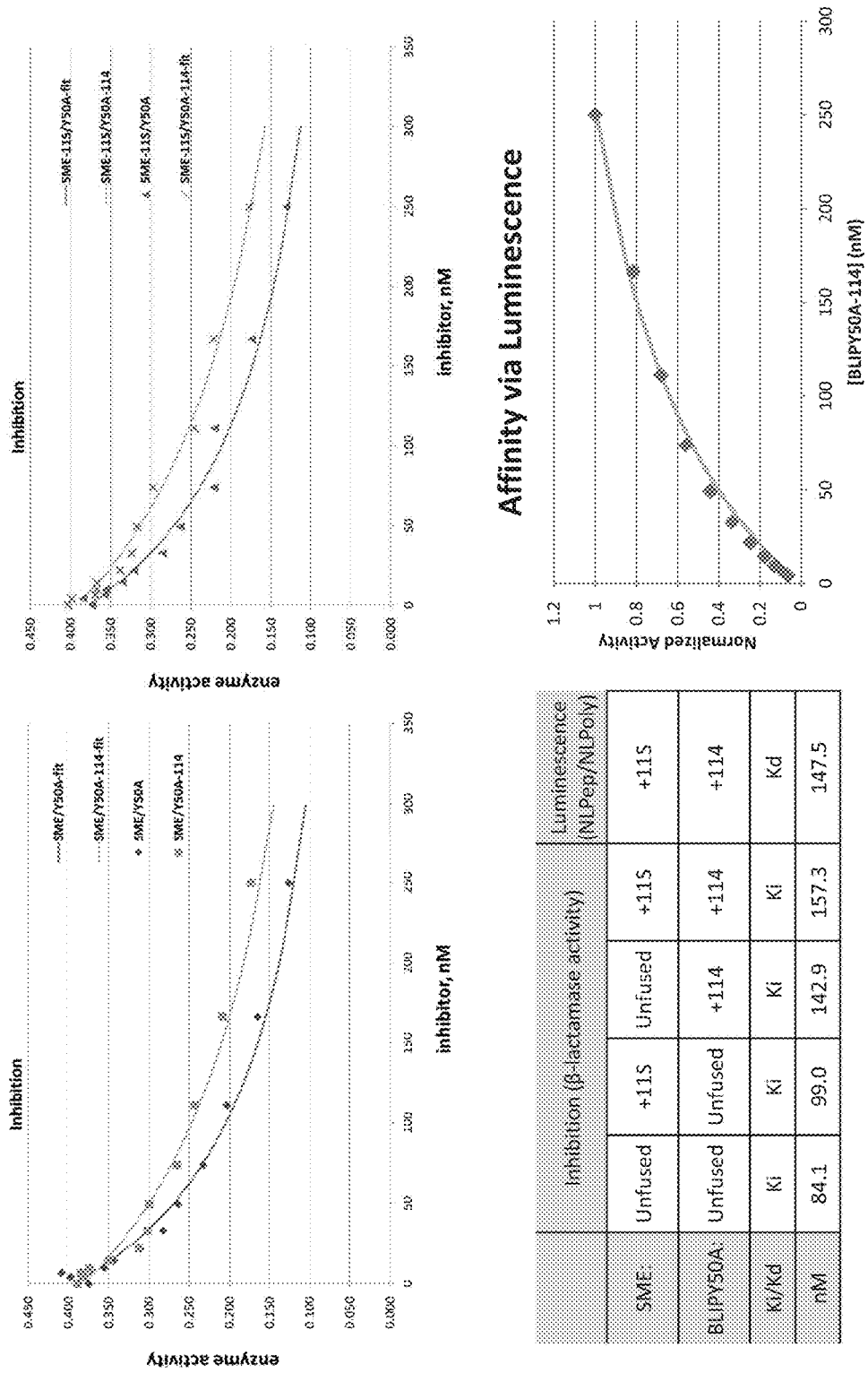

FIG. 162 shows graphs depicting a comparison of the affinity of the β-lactamase SME and its inhibitor BLIPY50A as unfused proteins or when fused to NLPoly11S and NLPep114.

Figure 163:
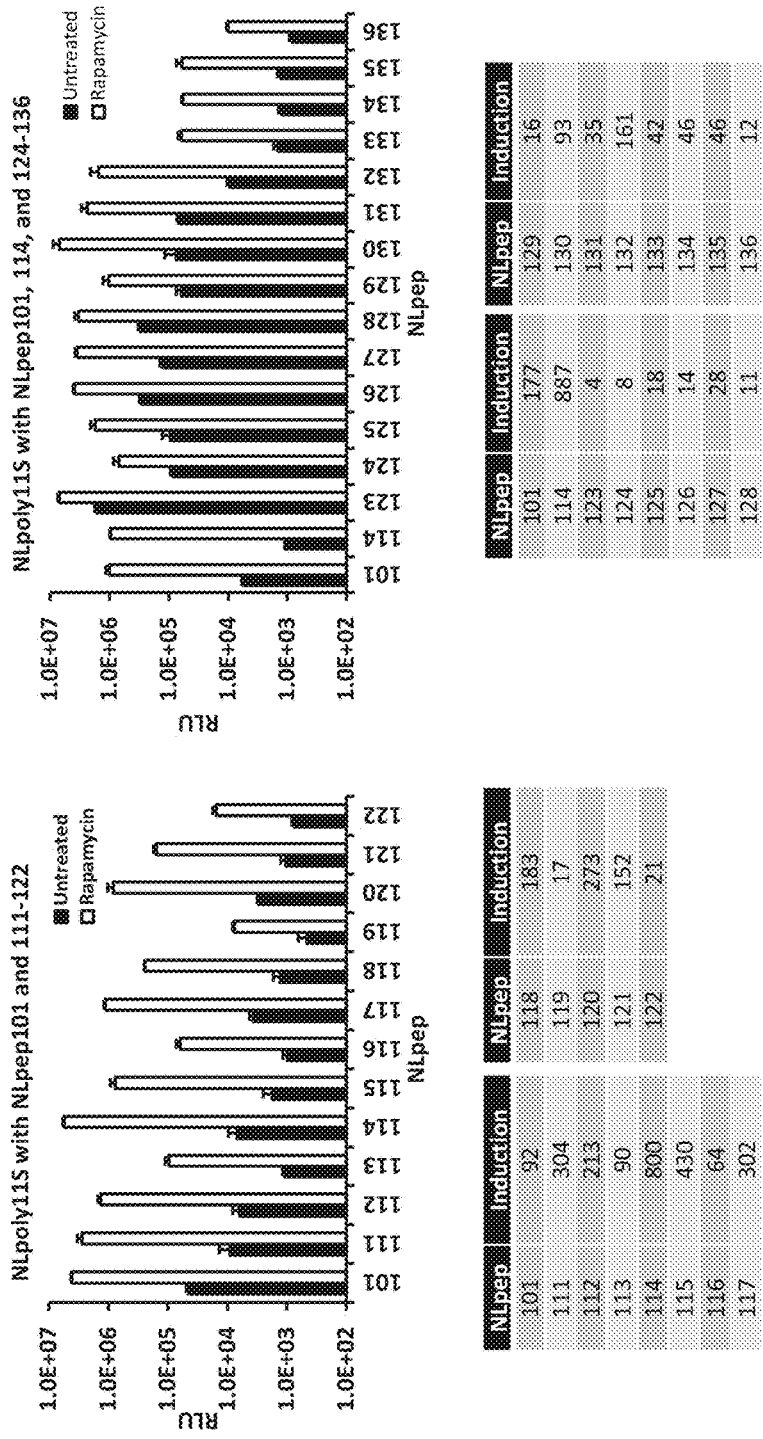
Figure 164:
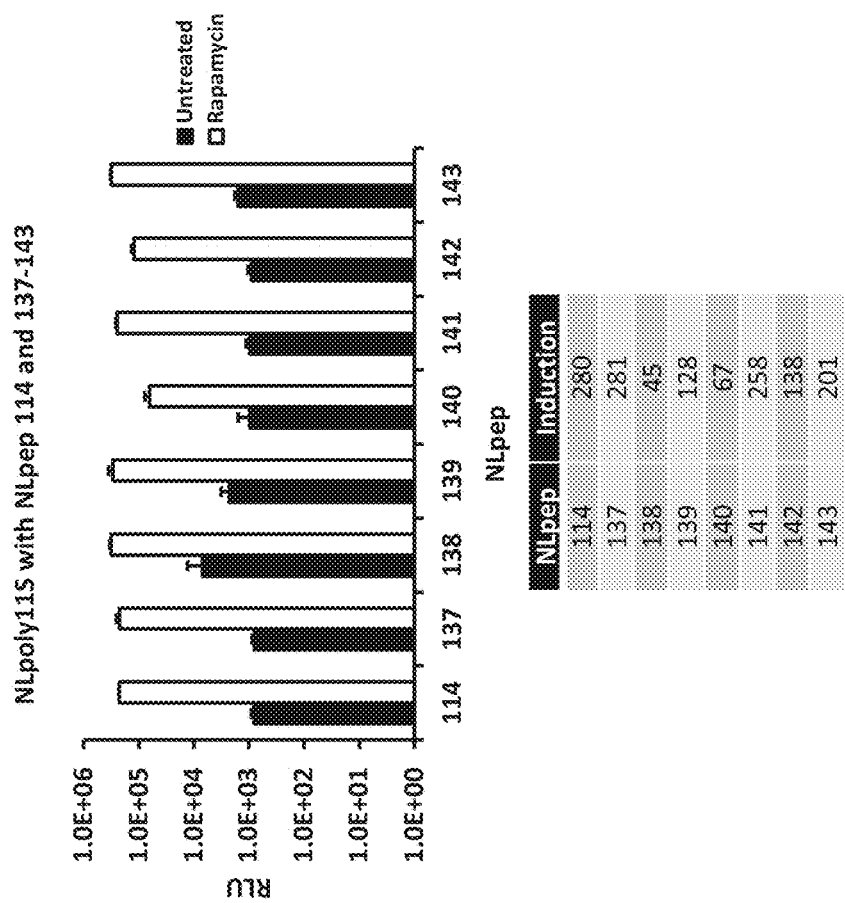

FIG. 163 shows a comparison of luminescence generated by cells expressing different combinations of FRB-NLpoly11S with FKBP-NLpep 101/111-136 FIG. 164 shows a comparison of luminescence generated by cells expressing different combinations of FRB-NLpoly11S with FKBP-NLpep 114 and 137-143.

Figure 165:
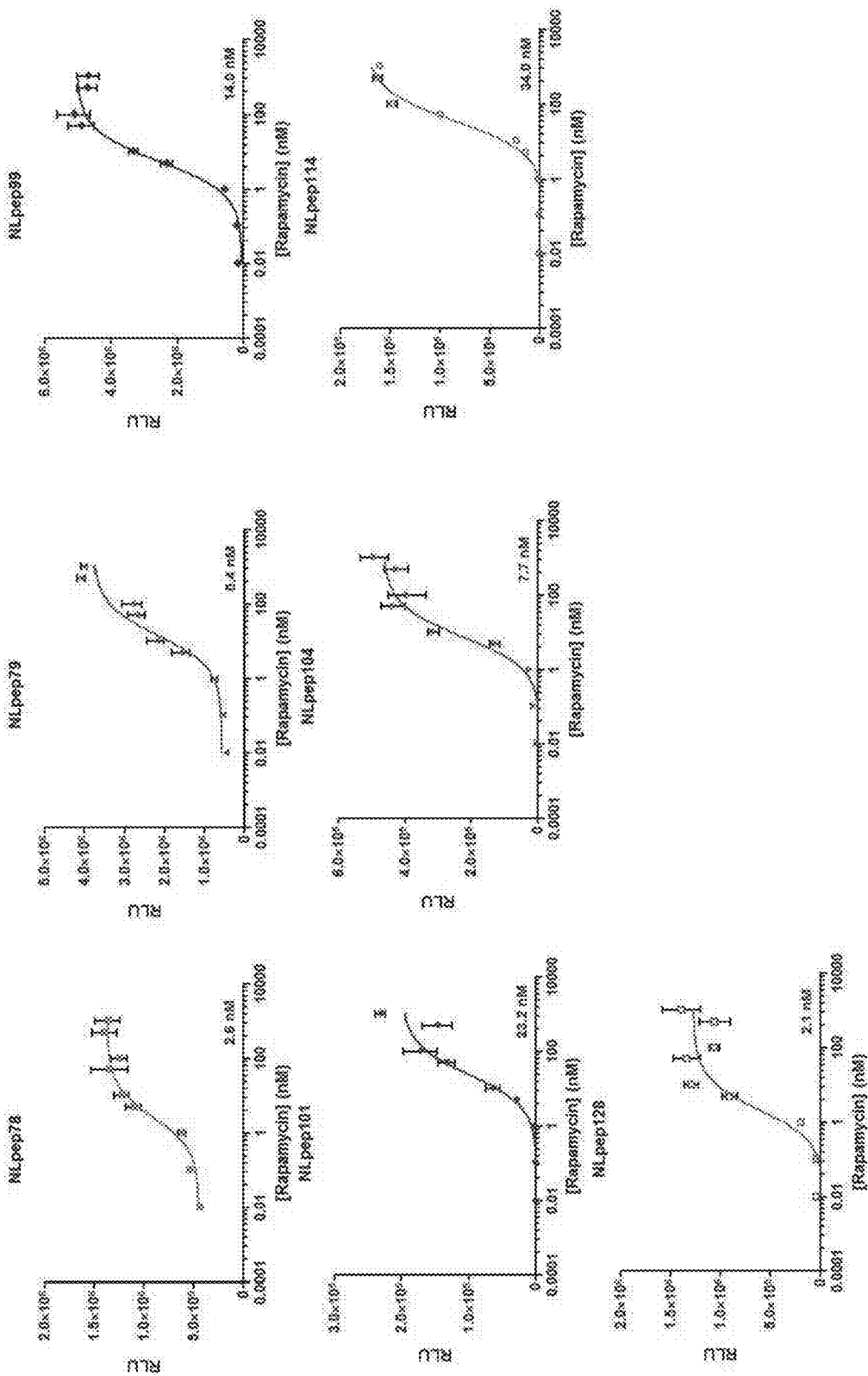

FIG. 165 shows rapamycin dose response curves of cells expressing FRB-NLpoly11S and FKBP-NLpep78/79/99/101/104/114/128

Figure 166:
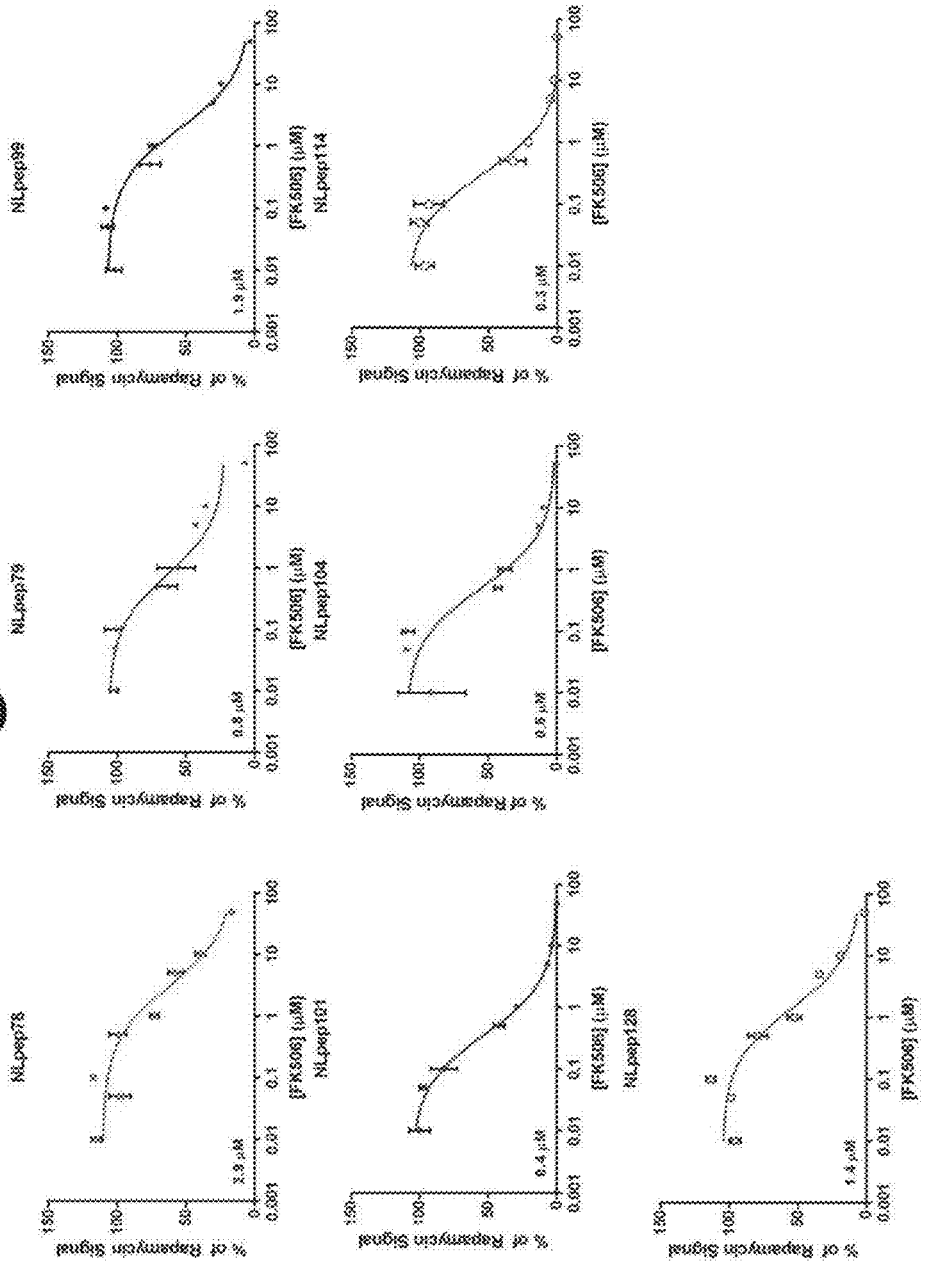
Figure 167:
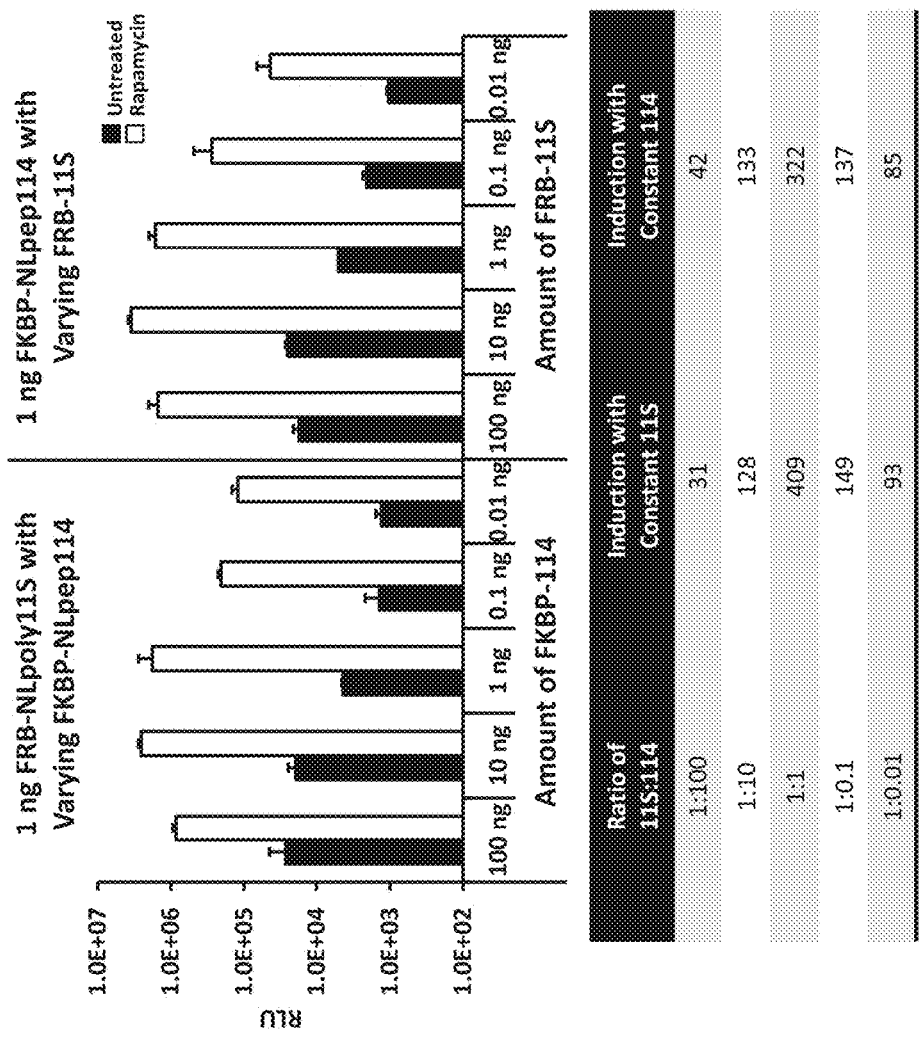

FIG. 166 shows response of cells expressing FRB-NLpoly11S and FKBP-78/79/99/101/104/114/128 to the rapamycin competitive inhibitor FK506 FIG. 167 shows a comparison of luminescence generated by cells transfected with different ratios of FRB-NLpoly11S and FKBP-NLpep 114.

Figure 168:
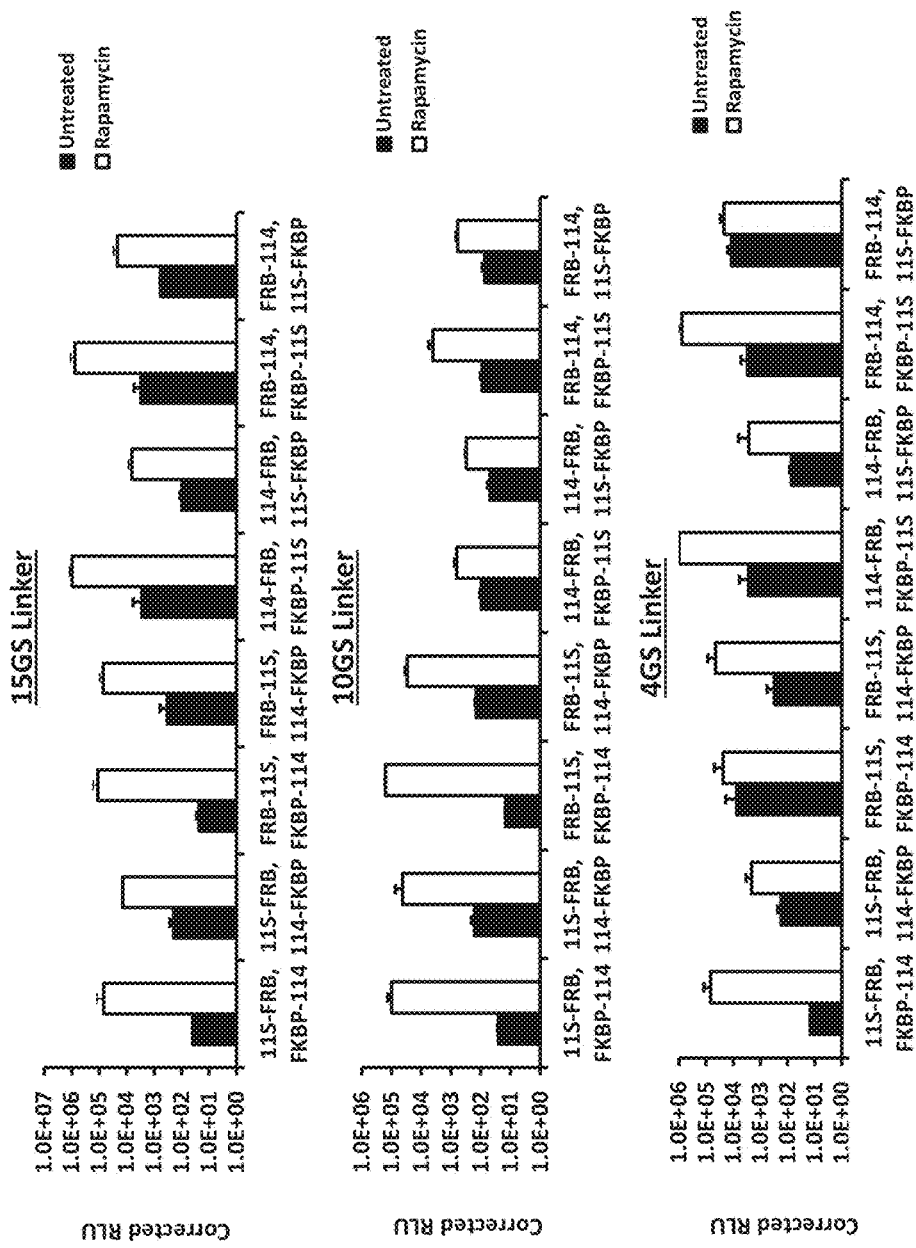

FIG. 168 shows a comparison of luminescence generated by cells expressing NLpoly11S/NLpep114 fusions of FRB/FKBP in different orientations and with different linker lengths.

Figure 169:
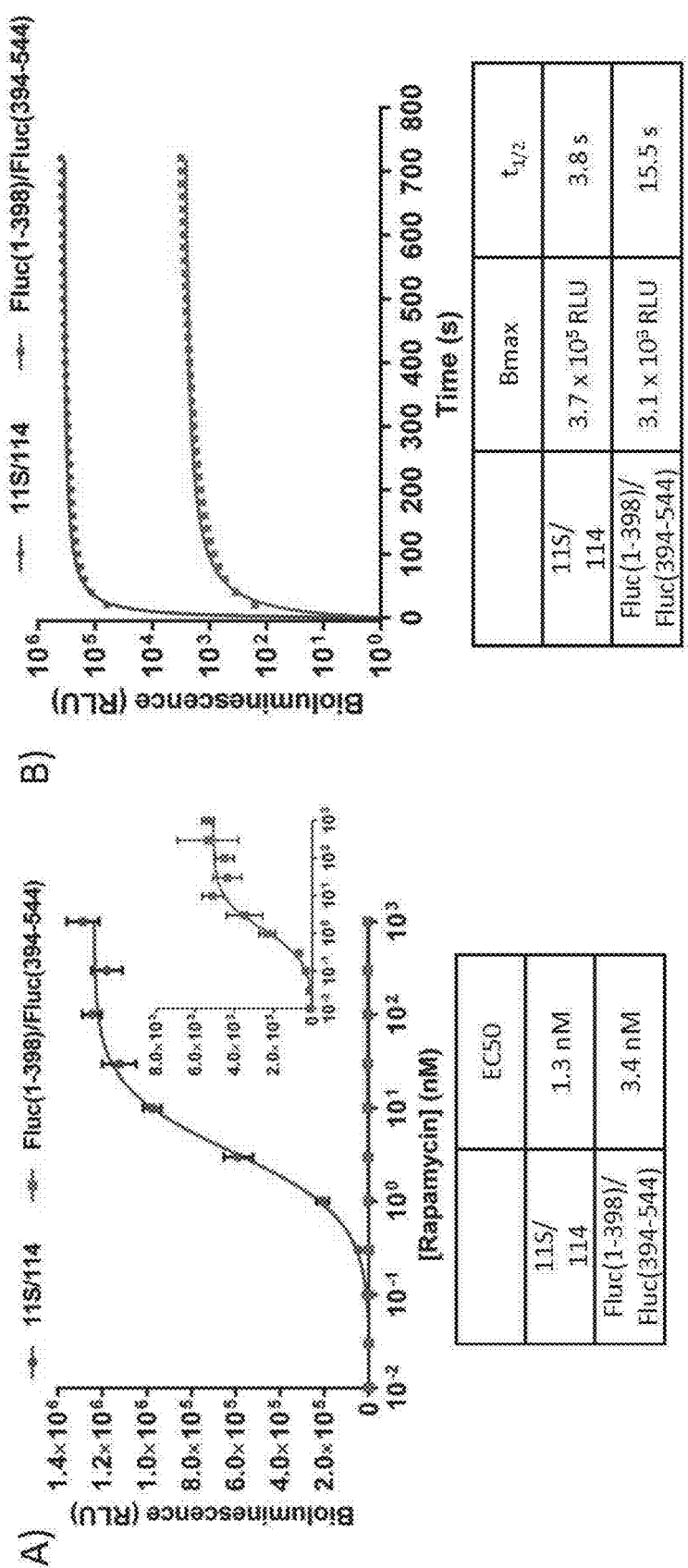

FIG. 169 shows graphs depicting rapamycin (A) dose-specific and (B) time-specific induction of FRB-NLpoly11S/FKBP-NLpep 114 or split firefly complementation signals.

Figure 170:
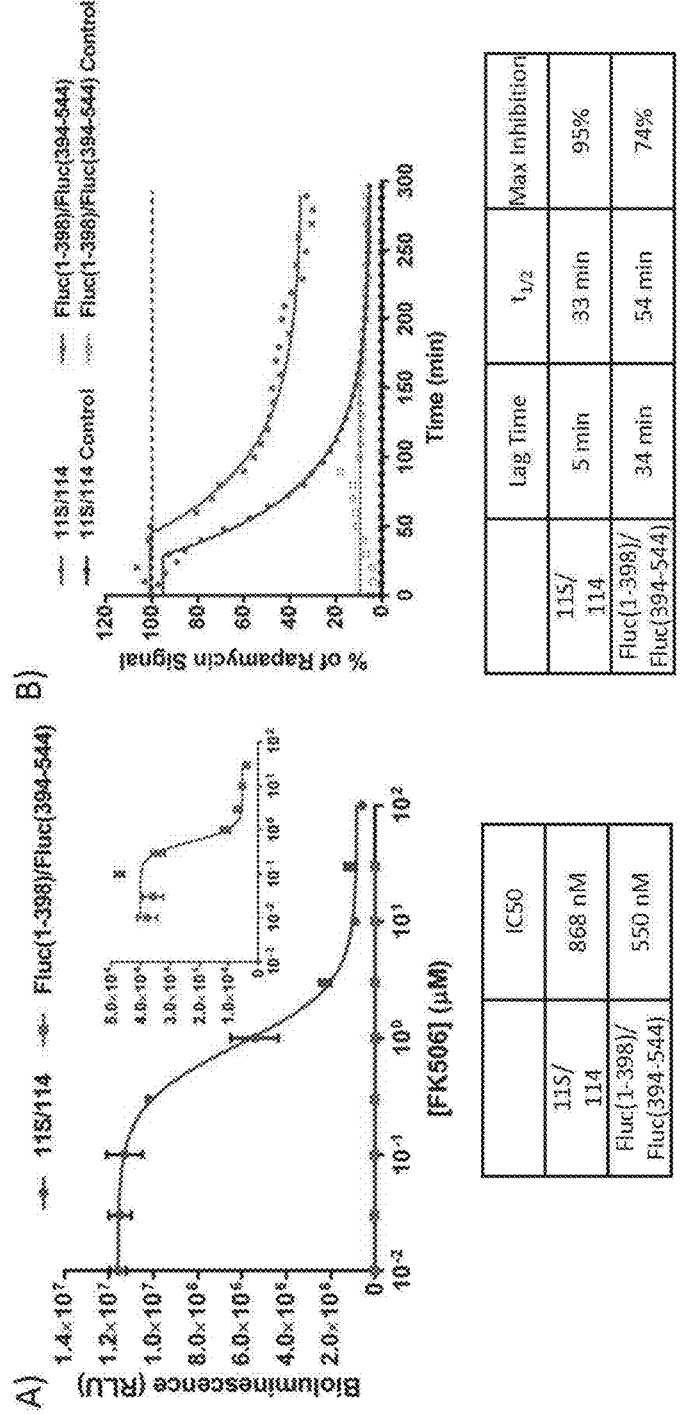

FIG. 170 shows graphs depicting FK506(A) dose-specific and (B) time-specific inhibition of FRB-NLpoly11S/FKBP-NLpep 114 or split firefly complementation signals.

Figure 171:
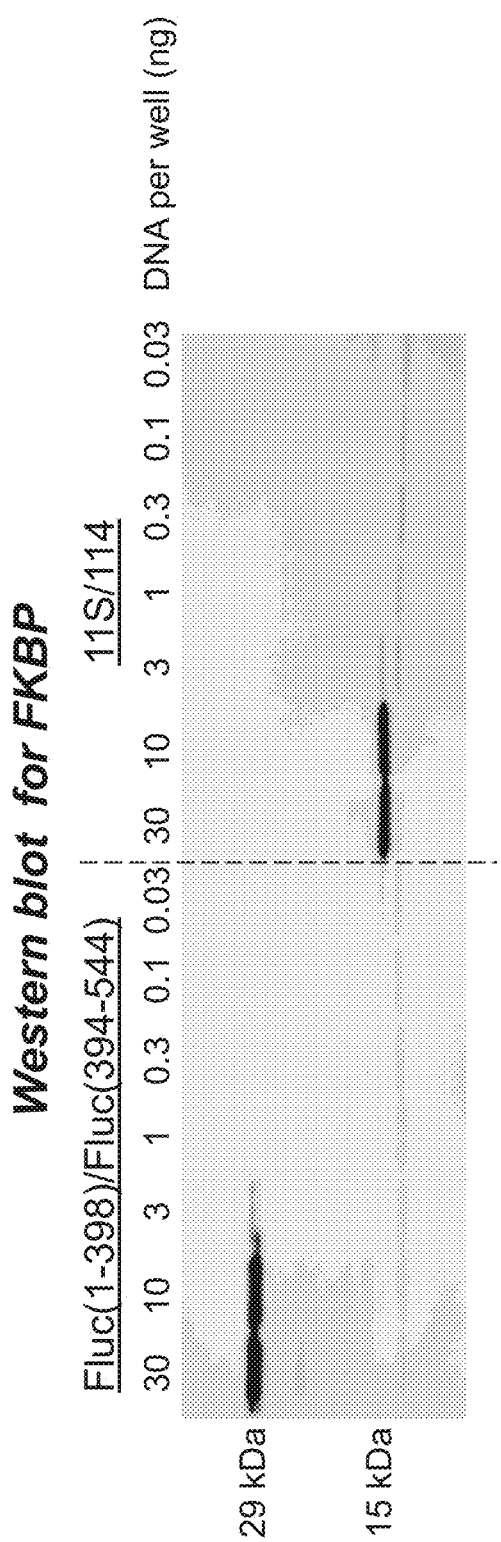

FIG. 171 shows Western blots depicting similar expression levels of FKBP-NLpep 114 and FKBP-Fluc(394-544) at equal levels of transfected DNA.

Figure 172:
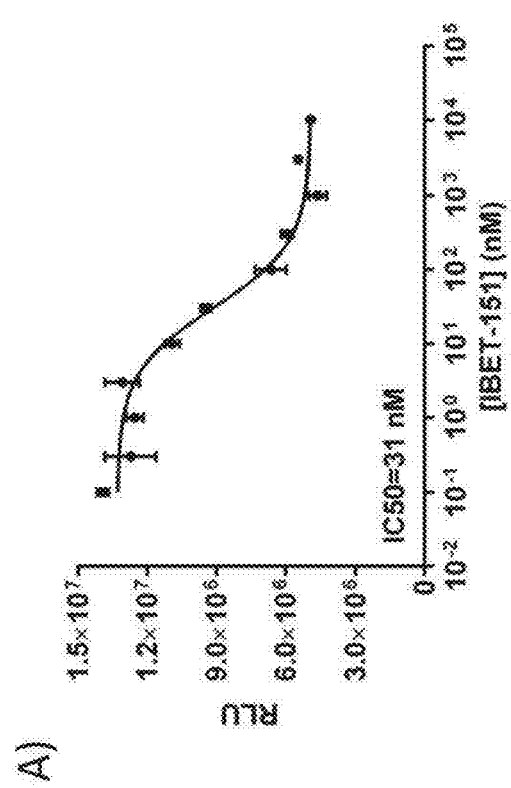

FIG. 172 shows graphs depicting (A) dose-specific and (B) time-specific inhibition of NLpoly11S-BRD4 and Histone H3.3-NLpep 114 interaction by IBET-151.

Figure 173:
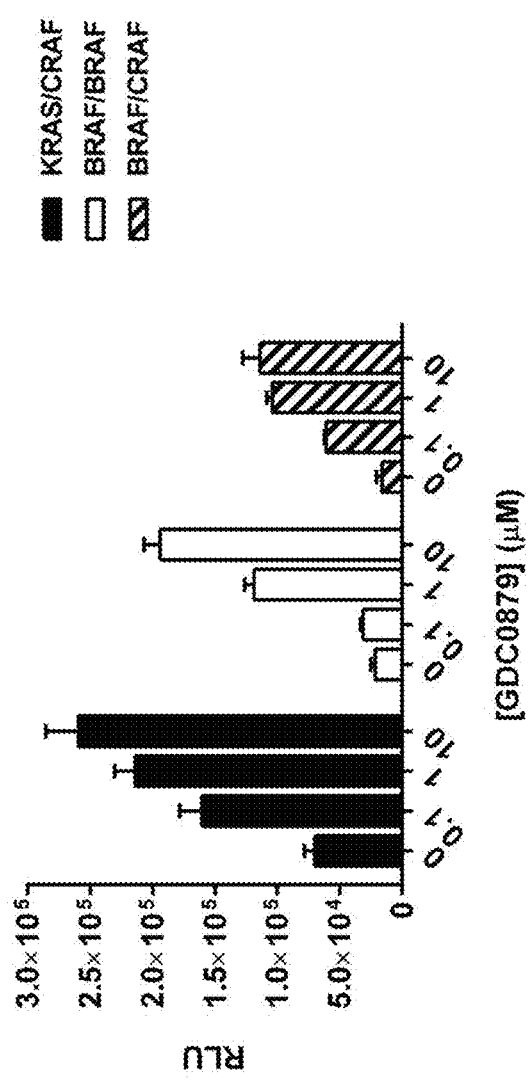

FIG. 173 shows a graph depicting dose dependent increases in RAS/CRAF, BRAF/BRAF and CRAF/BRAF dimerization in response to BRAF inhibitor GDC0879.

Figure 174:
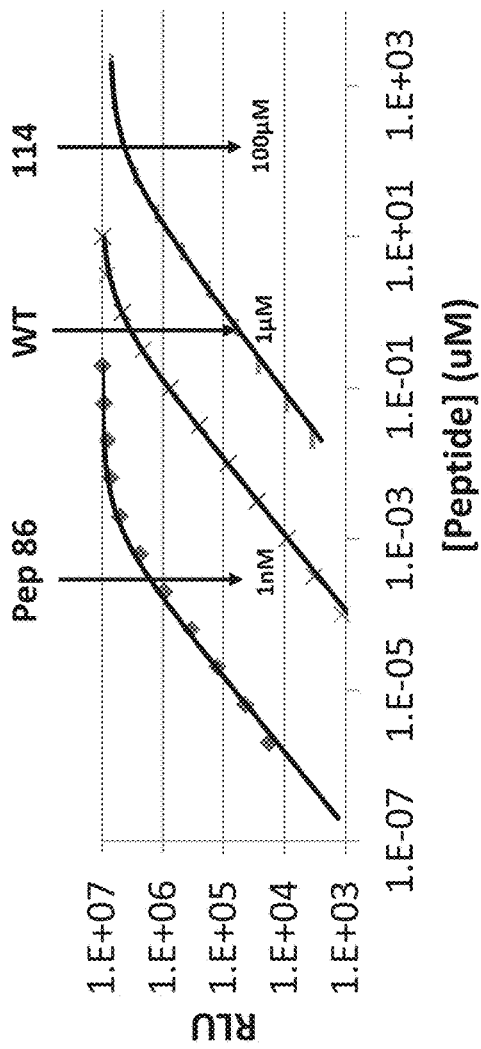

FIG. 174 shows a graph depicting RLU as a function of NLPep concentration for NLpoly11S and NLPep86 (SEQ ID NO: 390), wt (SEQ ID NO: 2578), and NLpep114 (SEQ ID NO: 2271).

FIG. 175 shows a schematic of an assay utilizing a high affinity peptide of a luminescent pair as an intracellular protein tag and the polypeptide of the luminescent pair as a detection reagent.

Figure 176:
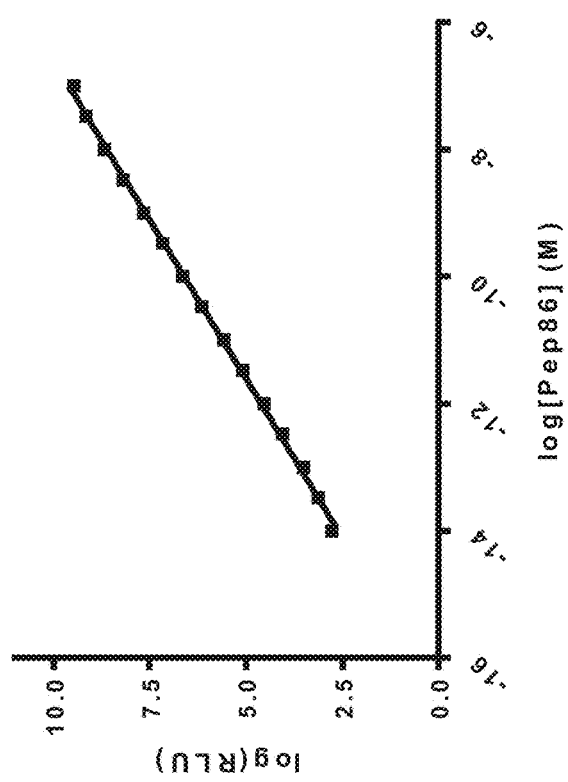

FIG. 176 shows a graph demonstrating the linear range of the affinity of NLpoly11S and MLpep86.

Figure 177:
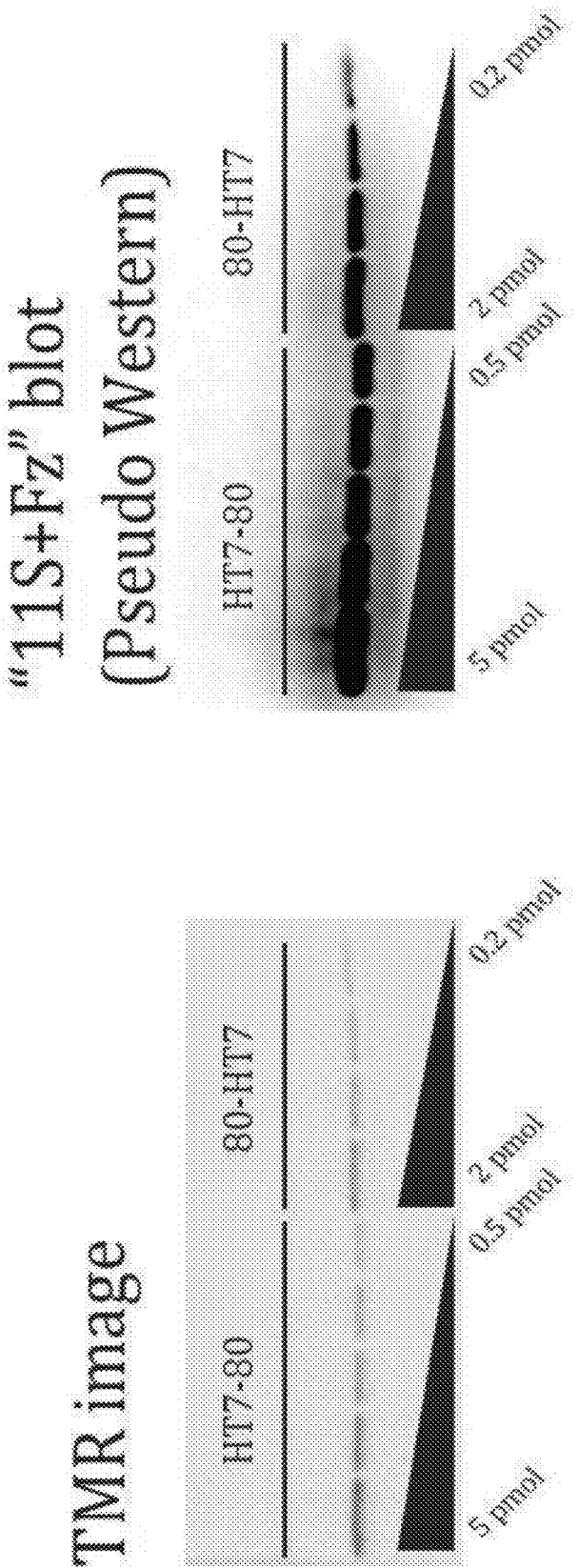

FIG. 177 shows images demonstrating the sensitivity of detecting proteins tagged with a high affinity NLPep using 11S. This figure also compares the detection using NLPep/NLPoly to the detection using fluorescently labeled HALOTAG.

Figure 178:
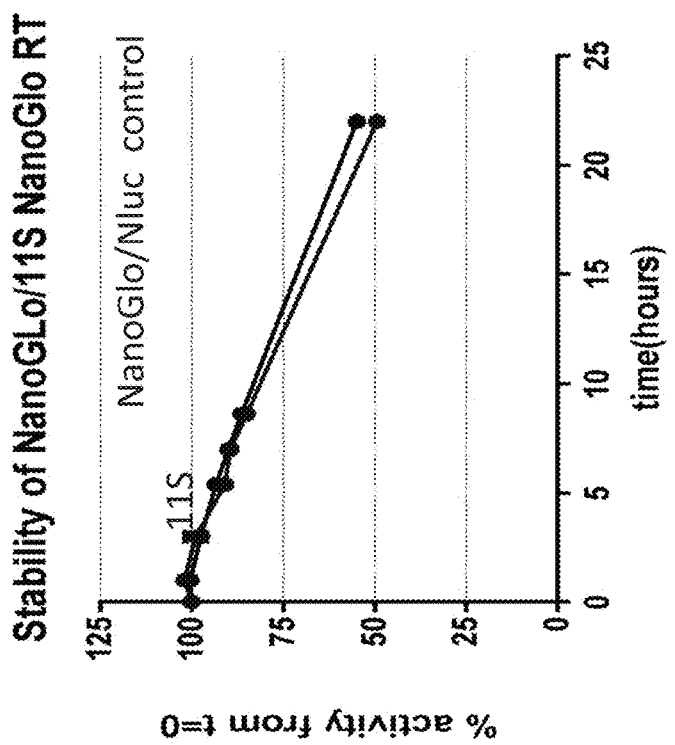

FIG. 178 shows a graph demonstrating the stability of NLpoly11S.

Figure 179:
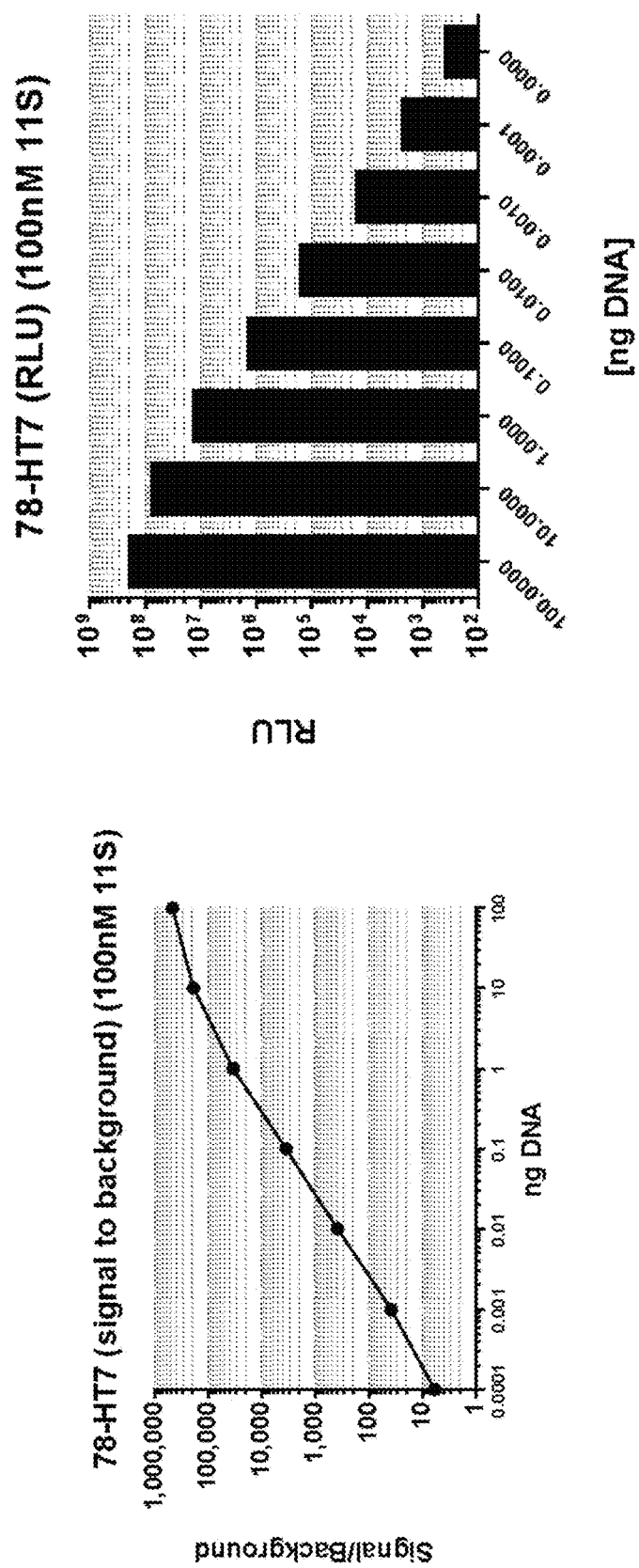

FIG. 179 shows a graph demonstrating the linear range of the affinity of NLpoly11S and NLpep78.

FIG. 180 shows a summary of NLpep sequences. High affinity (spontaneous) peptides are those peptides (NLpep) which bind to NLpoly11S with high affinity. Dark/Quencher peptides are those peptides (NLpep) which can reduce the levels of light being produced or detected from NLpoly11S.

Figure 181:
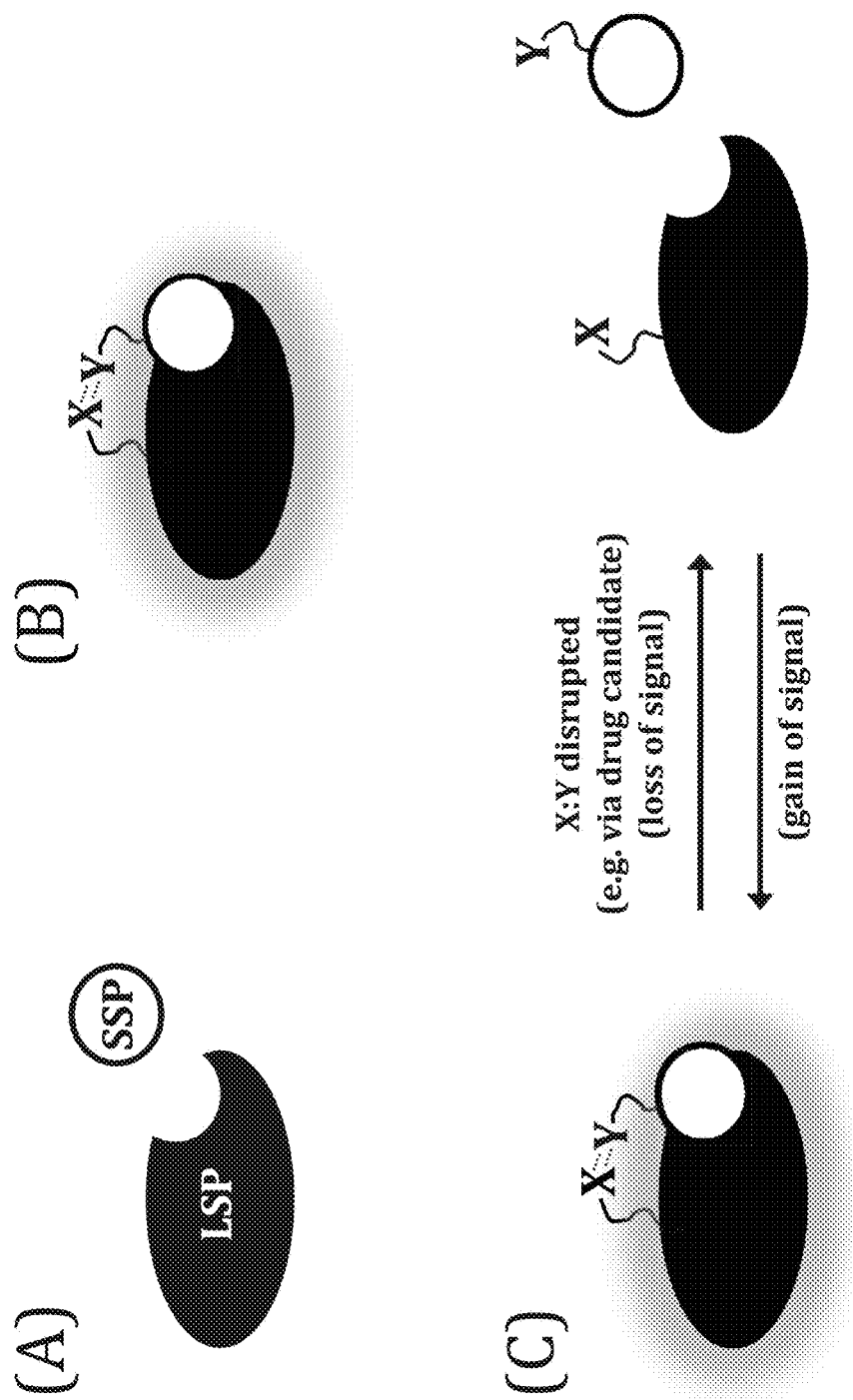

FIG. 181 shows a schematic for the concept of structural complementation where the LSP and SSP (i.e., NLpoly and NLpep) are brought together to produce a bioluminescent signal (panels A. B). Upon disruption of a protein interaction (i.e. X and Y), LSP and SSP come apart resulting in a decrease in luminescence (Panel C).

FIGS. 182A-B show two options (A, B) for engineering structural complementation to be a loss of signal upon protein interaction between X and Y and a gain of signal upon disruption of the interaction between X and Y. Option A represents intermolecular structural complementation. Option B represents intramolecular structural complementation. FIG. 182B shows a list of genetic constructs that could be suitable for intramolecular structural complementation.

Figure 183:
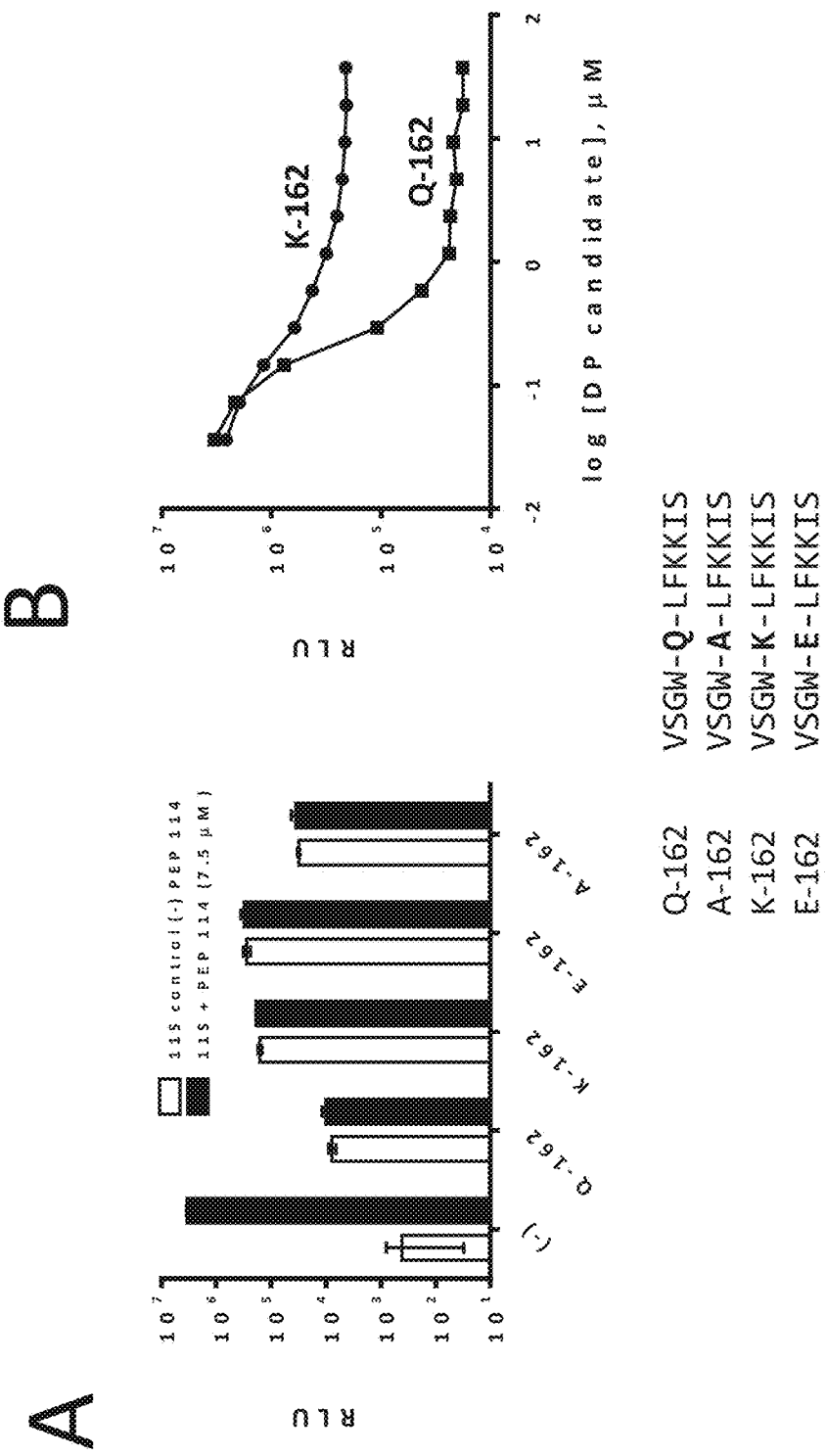

FIG. 183 shows (A) inhibition of NLpoly11S and NLpep 114 binding by various dark peptides, and (B) dose-dependent inhibition by Lys-162 and Gln-162 peptides.

Figure 184:
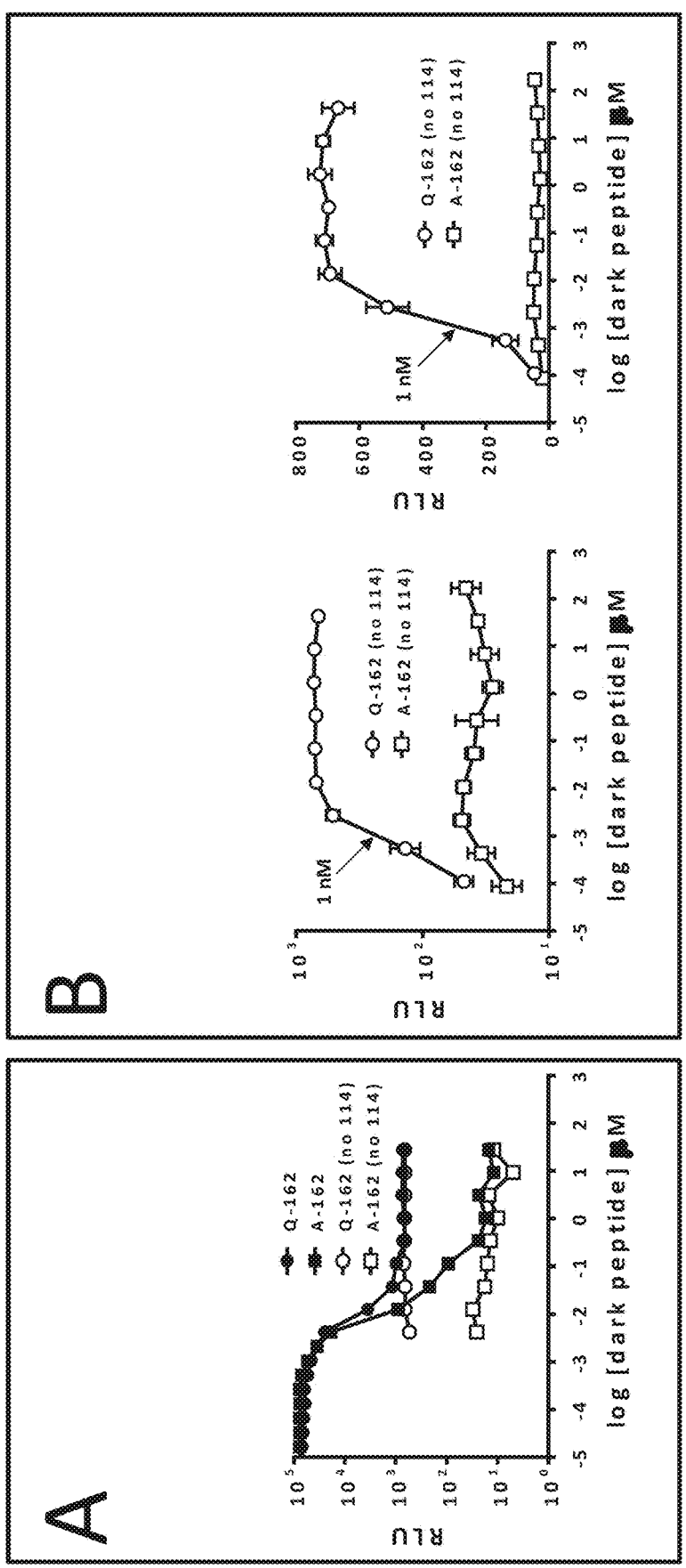

FIG. 184 A shows that inhibition by Q-162 and A-162 is dose-dependent. Panel B shows that Q-162 produces a signal on its own in a dose-dependent manner, while the dose-dependency of A-162 is subtle at best.

Figure 185:
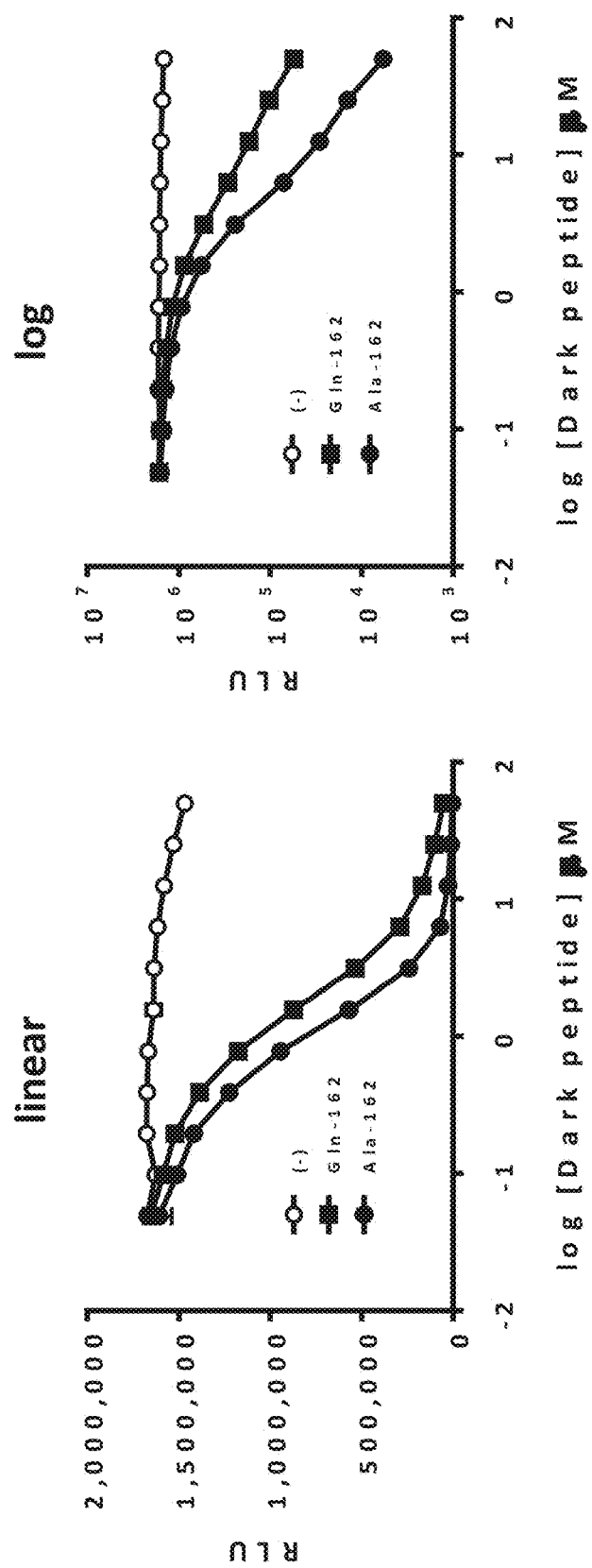

FIG. 185 shows graphs demonstrating dose-response of the dark peptides with CP Nluc.

Figure 186:
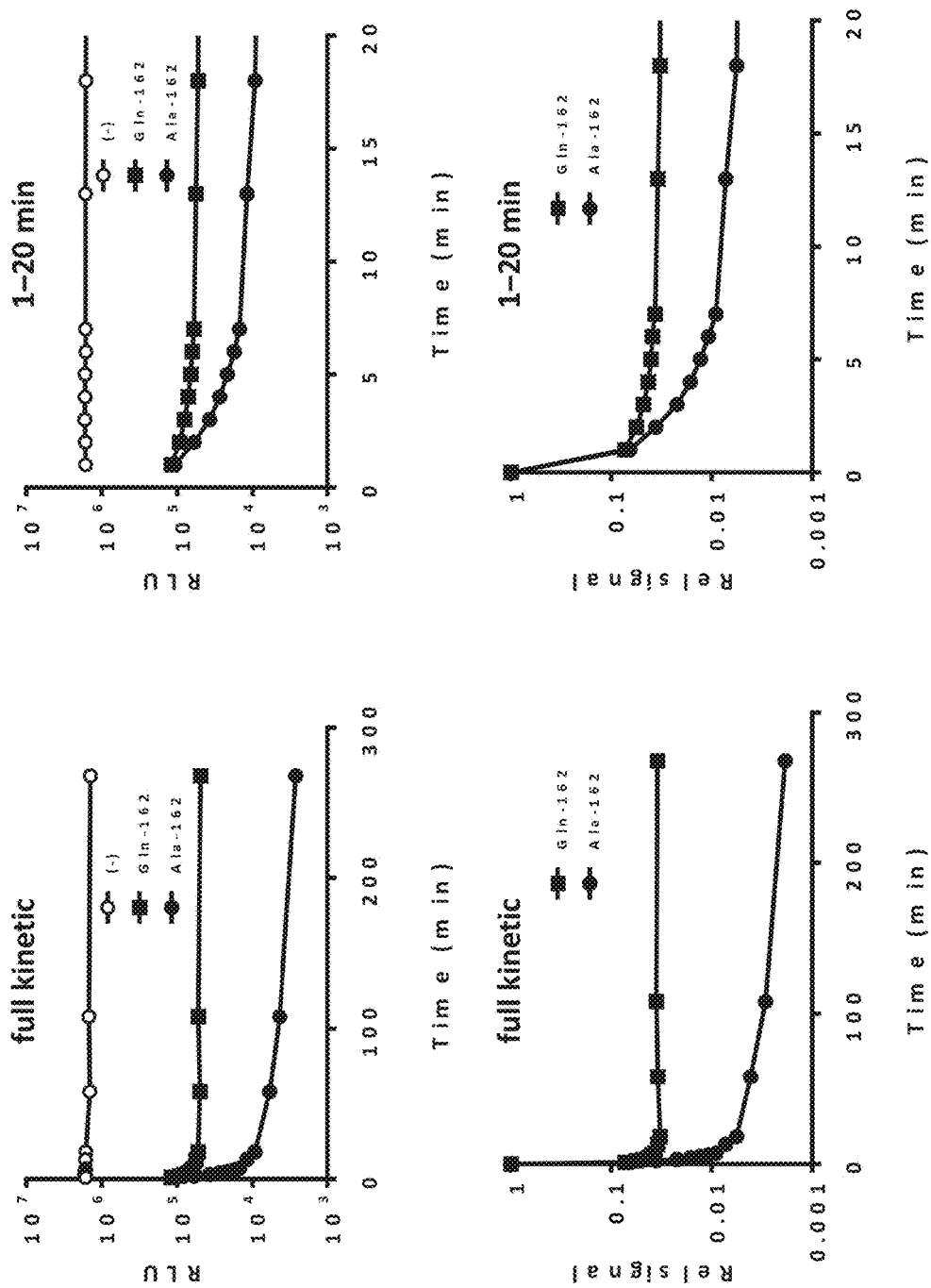

FIG. 186 shows graphs depicting a time course of dark peptide with CP Nluc.

Figure 187:
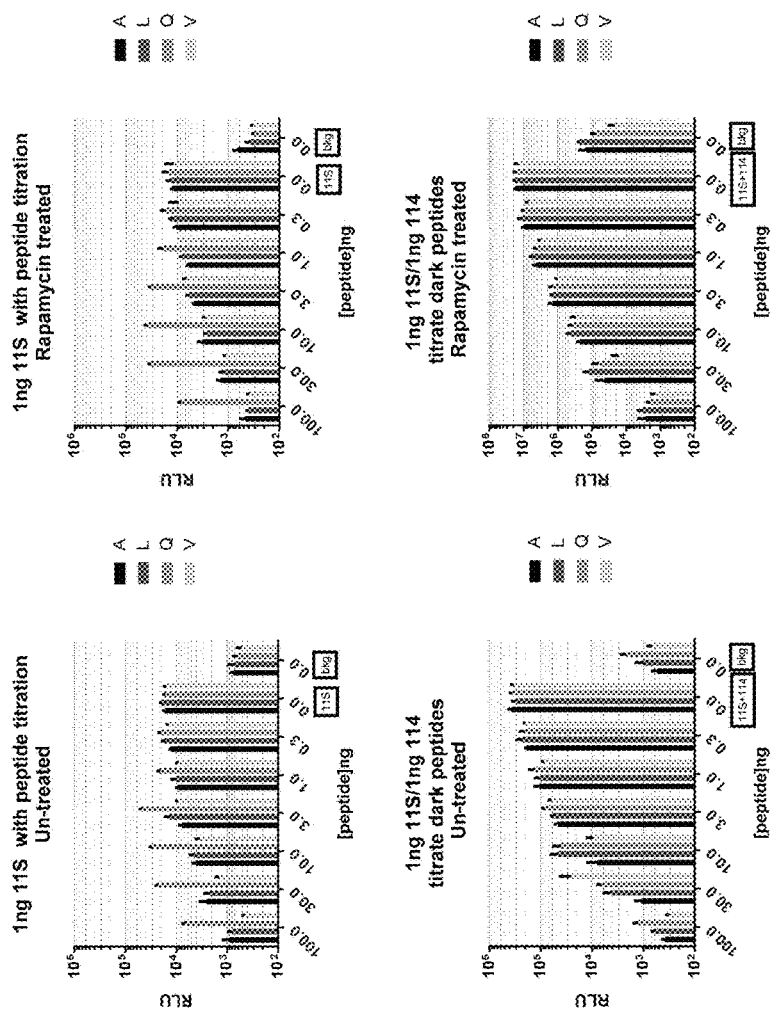

FIG. 187 shows the dark peptide dose-dependent inhibition of luminescence generated from FRB-NLpoly11S alone and also between FRB-NLpoly11S and FKBP-NLpep114 in the presence and absence of rapamycin.

Figure 188:
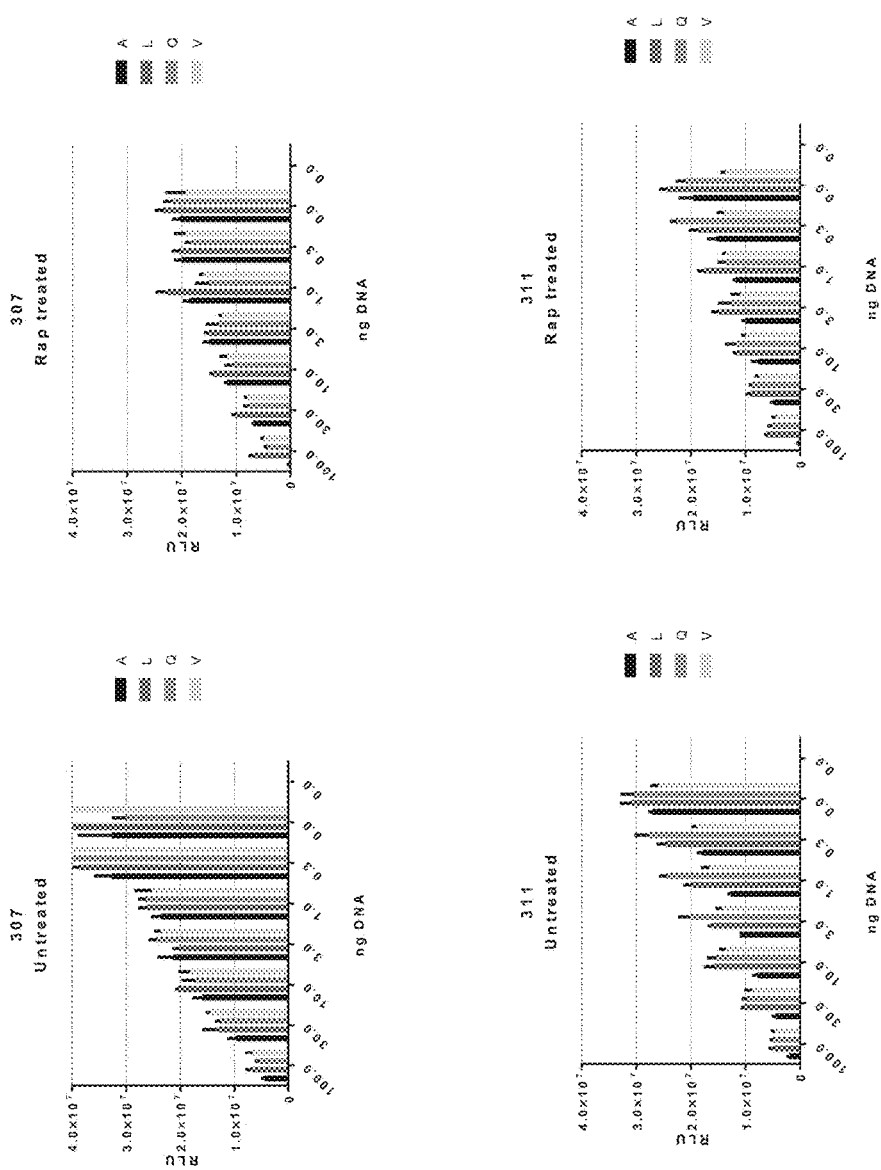

FIG. 188 shows the dark peptide dose-dependent inhibition of luminescence generated from either FRB-NANOLUC (311) or NANOLUC-FRB (307) in the presence and absence of rapamycin (RLU).

Figure 189:
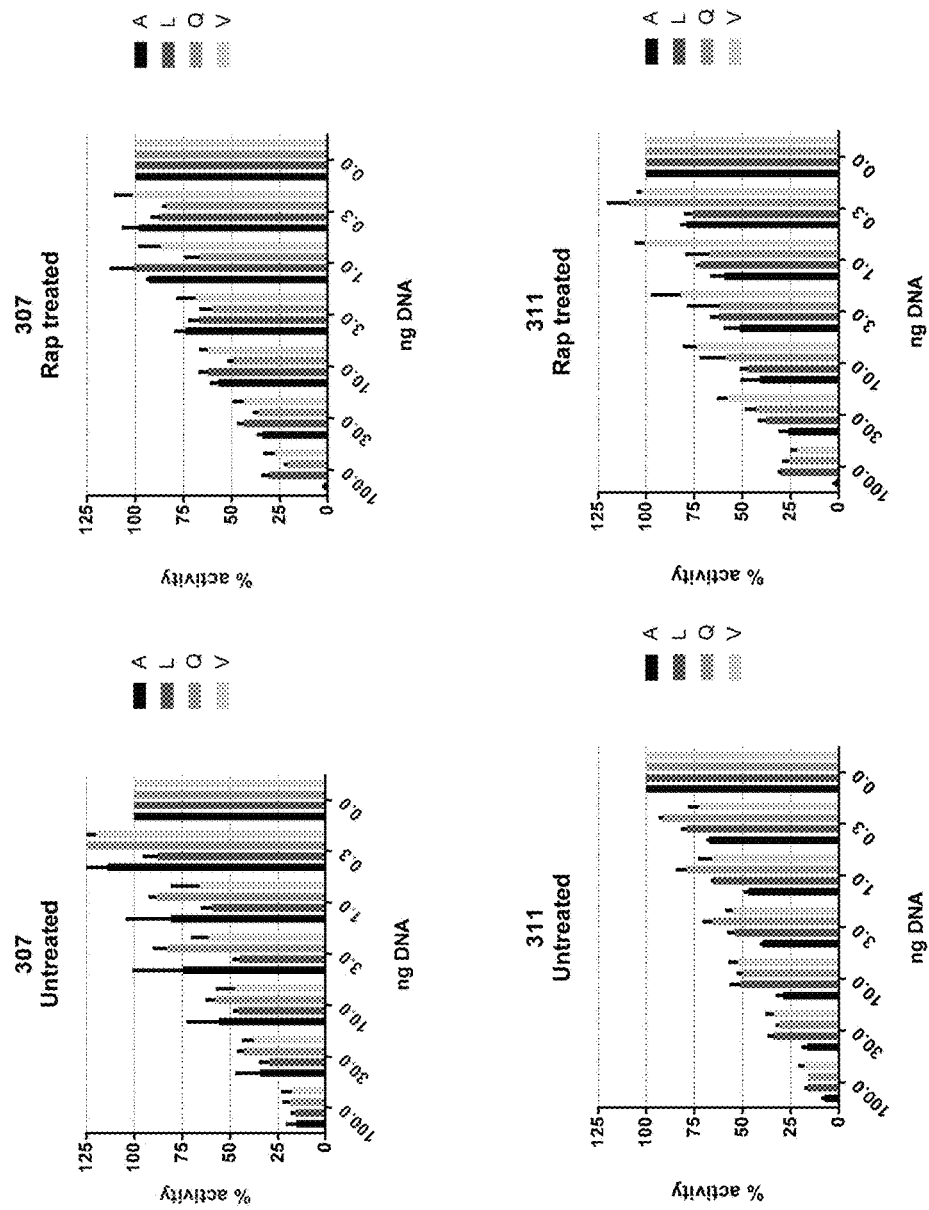

FIG. 189 shows the dark peptide dose-dependent inhibition of luminescence generated from either FRB-NANOLUC (311) or NANOLUC-FRB (307) in the presence and absence of rapamycin (normalized to no dark peptide control: 100%).

Figure 190:
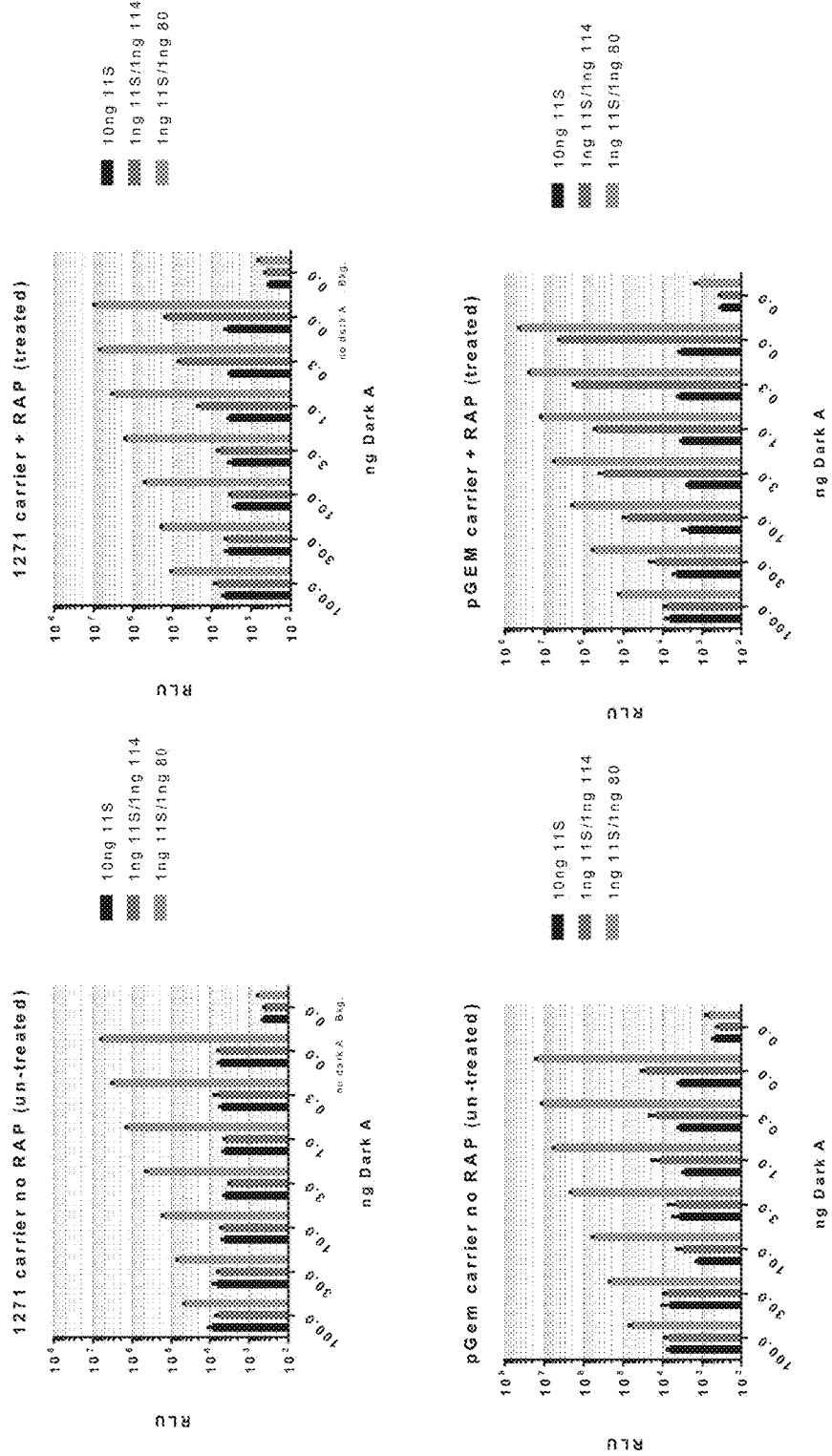

FIG. 190 shows that the dark peptides, when fused to FKBP, can compete with both low (114) and high (80) affinity peptides (also FKBP fusions) and as a result reduce the total luminescence being produced and detected in live cells.

FIG. 191 shows the signal comparison between Fluc and NLpep86-based assays for intracellular levels of Fluc. The table depicts SEQ ID Nos: 172, 390, and 2581-2585.

Figure 192:
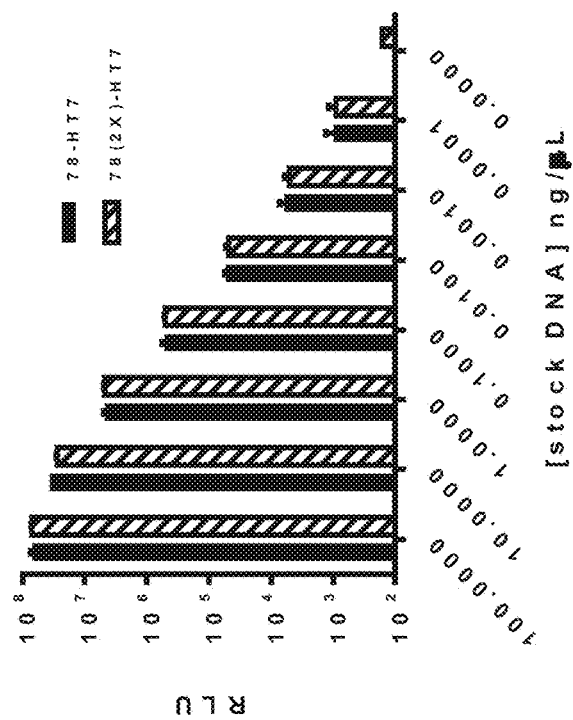

FIG. 192 shows graphs demonstrating the utility of tandem linked NLpeps in complementing Npoly11S.

Figure 193:
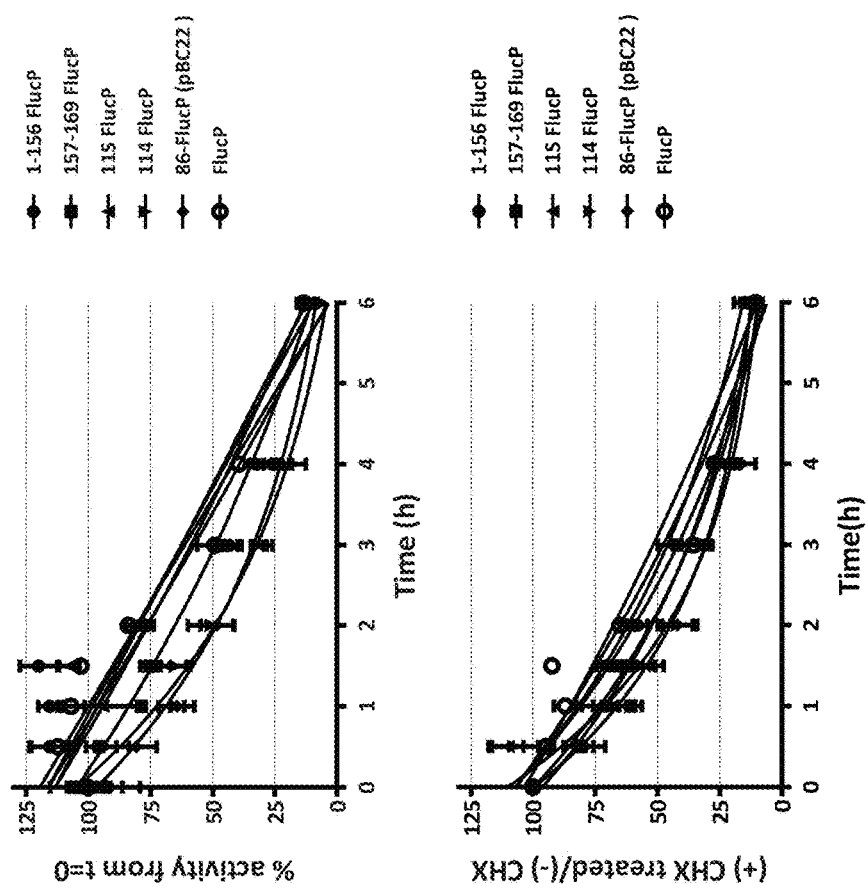

FIG. 193 shows a graph demonstrating that NLpoly and NLpep components do not interfere with intracellular degradation of reporter protein FlucP.

Figure 194:
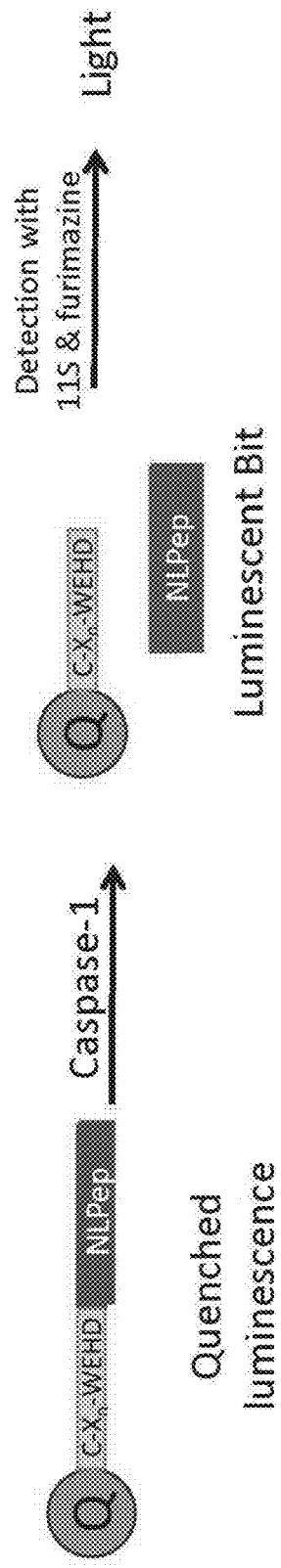

FIG. 194 shows a schematic demonstrating and extracellular protease activity assay.

Figure 195:
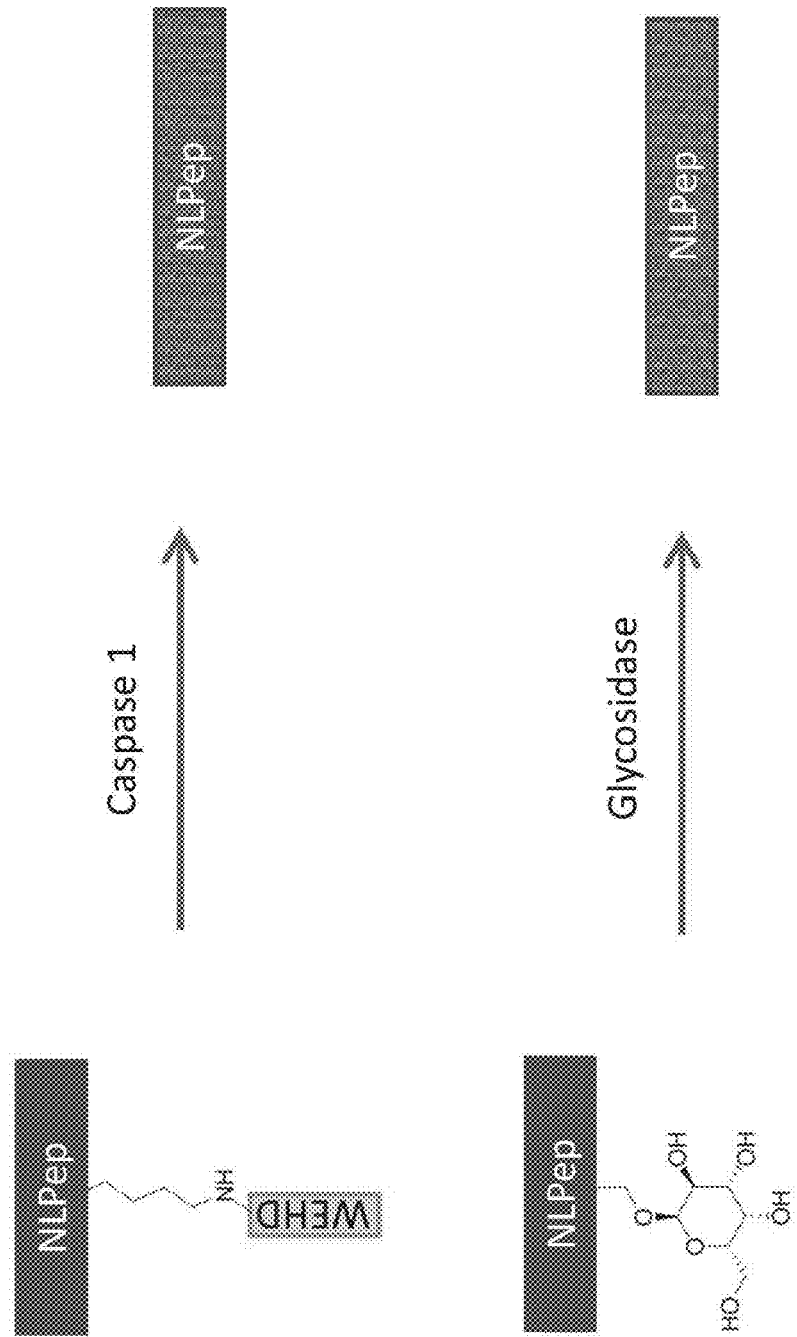

FIG. 195 shows a schematic of an assay for measuring the activity of an enzyme using a ProNLpep.

Figure 196:
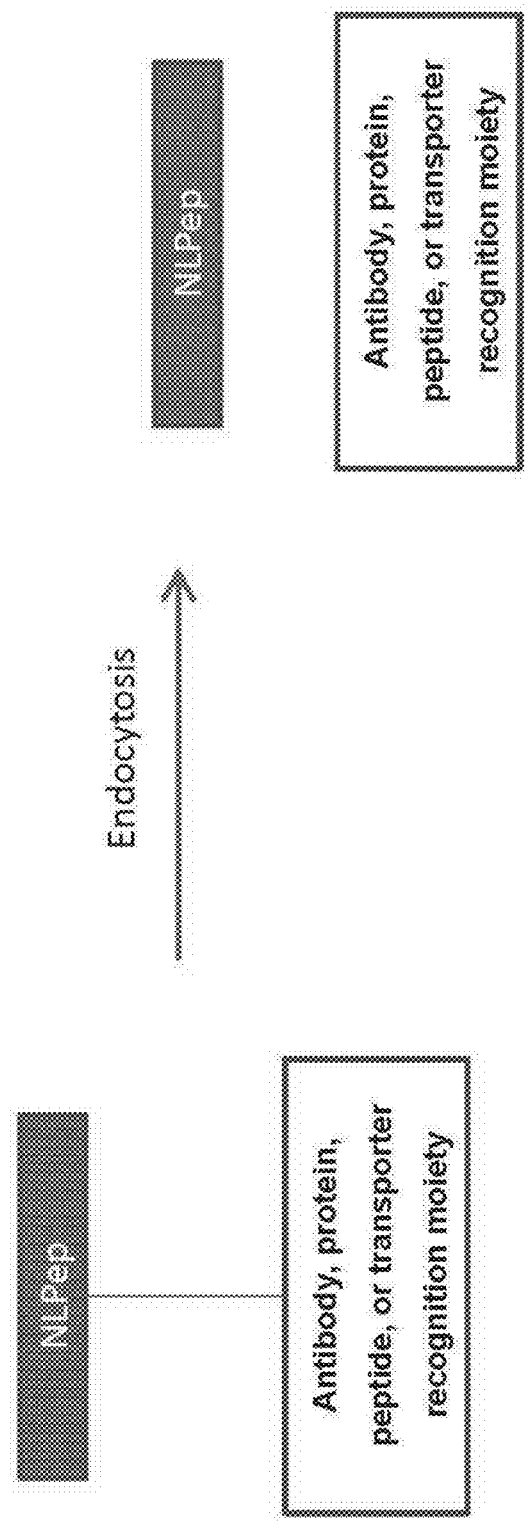

FIG. 196 shows a schematic of an assay for screening antibodies, proteins, peptides or transporters that mediate cellular internalization.

Figure 197:
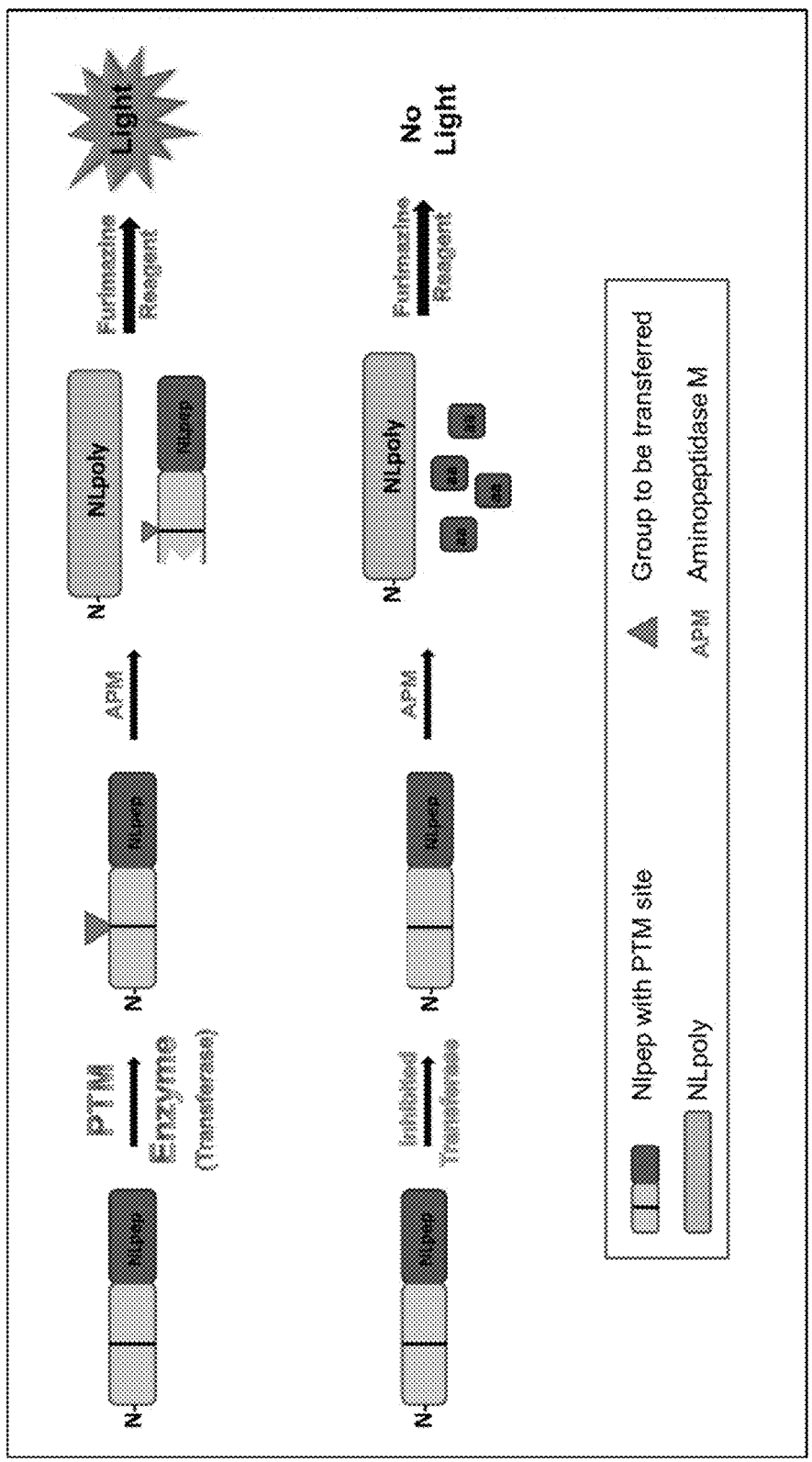

FIG. 197 shows a schematic of a post-translational modification transferase assay.

Figure 198:
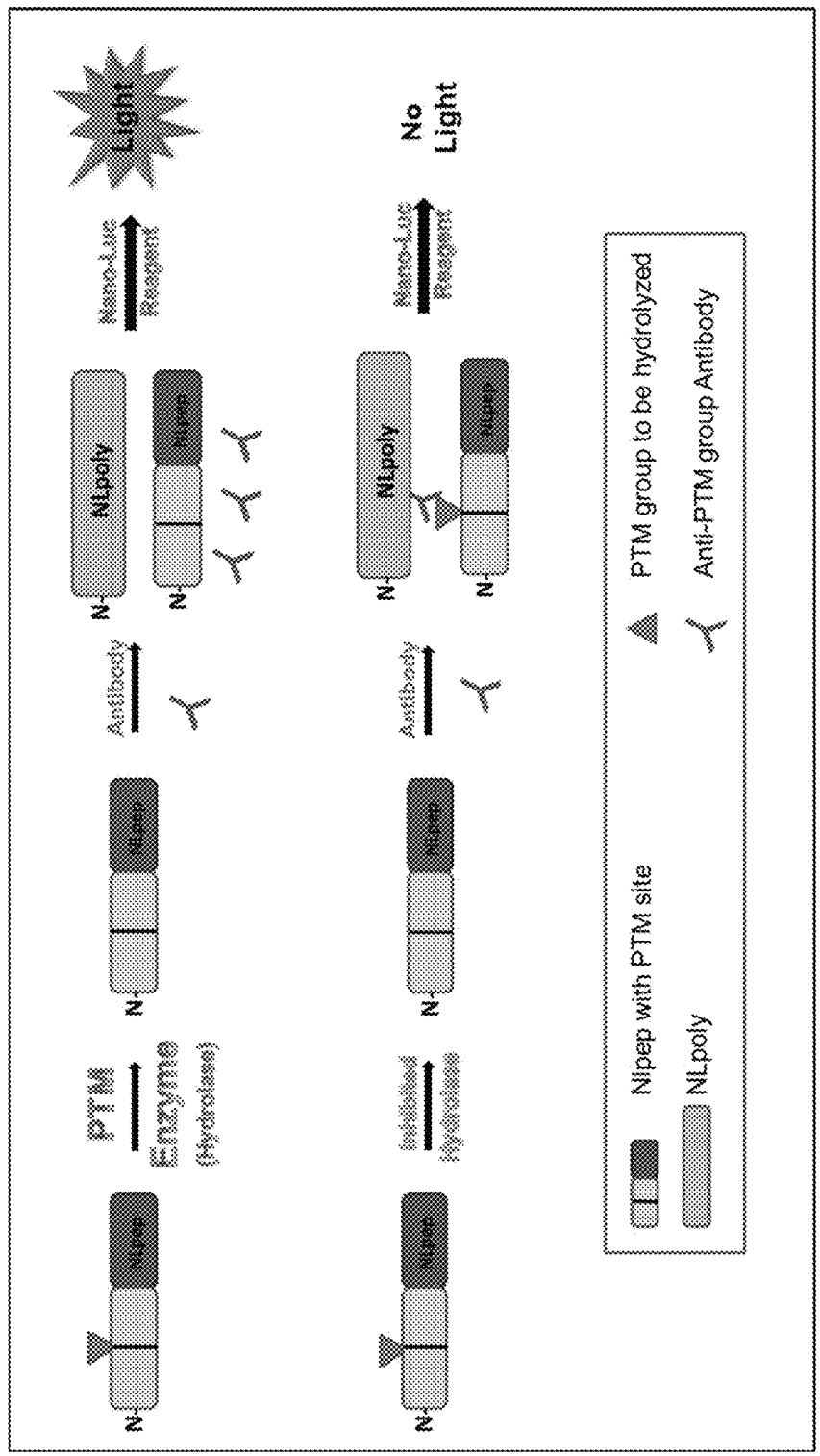

FIG. 198 shows a schematic of a post-translational modification hydrolase assay.

Figure 199:
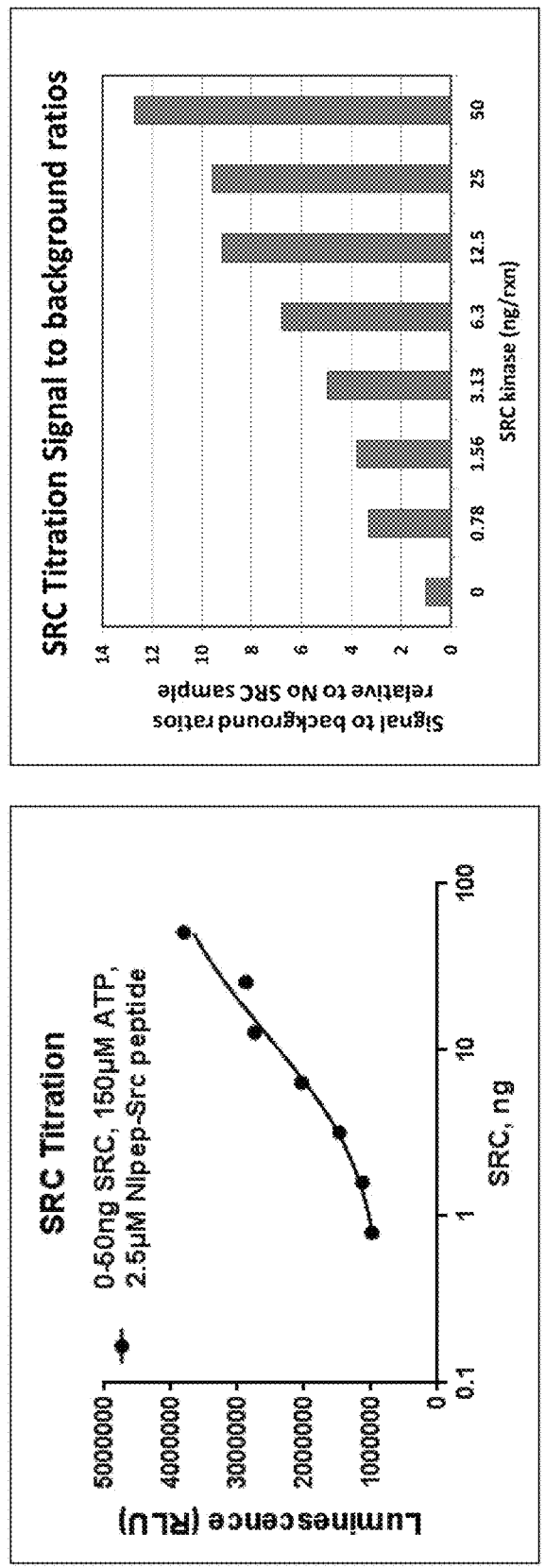

FIG. 199 shows graphs correlating Tyrosine Kinase SRC activity with luminescence over background in a post-translational modification assay.

Figure 200:
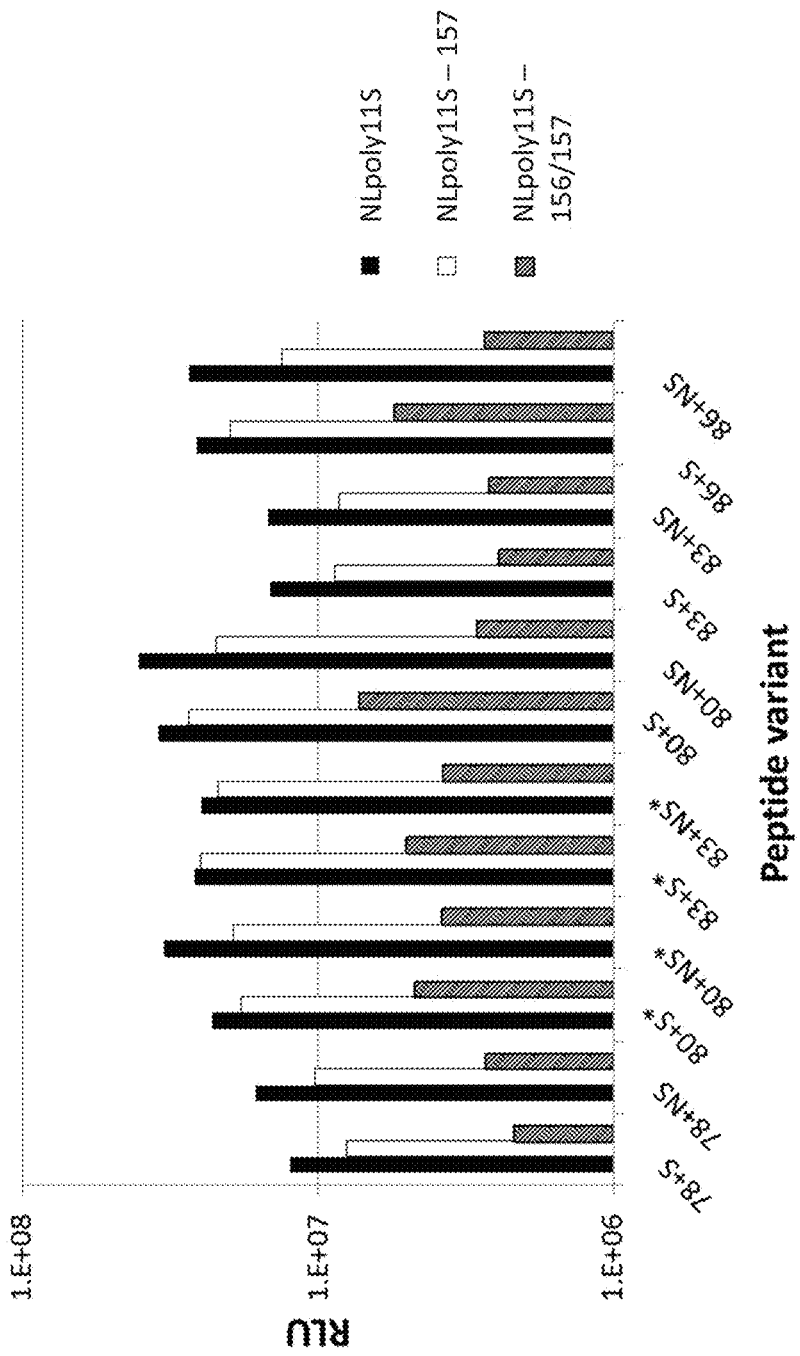

FIG. 200 shows a graph depicting spontaneous complementation of three different versions of NLpoly11S with twelve synthetic peptides.

Figure 201:
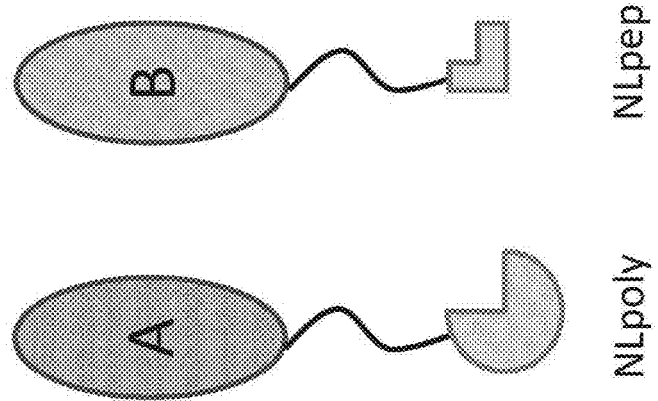

FIG. 201 shows a schematic of a homogeneous immunoassay format utilizing fusions of NLpep and NLpoly with separate binding moieties A and B.

Figure 202:
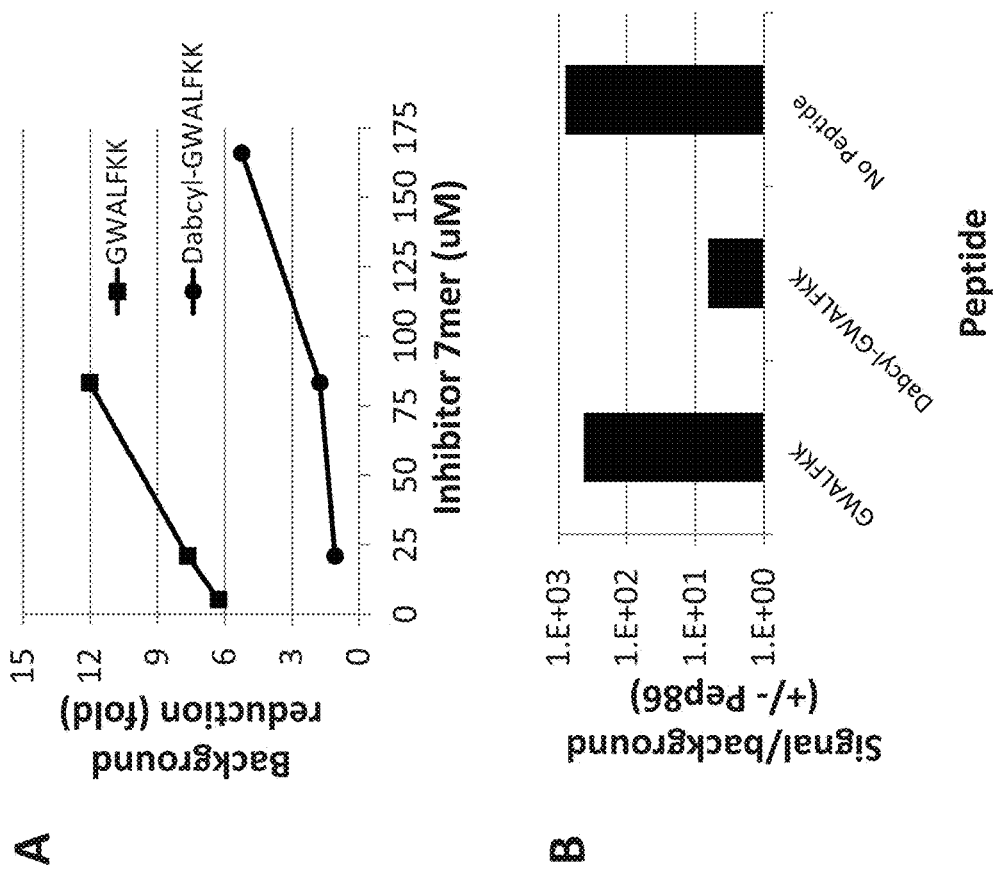

FIG. 202 shows graphs demonstrating: (A) reduction in background luminescence from NLpoly11S upon complex formation with GWALFKK (SEQ ID NO: 2351) and Dabcyl-GWALFKK (SEQ ID NO: 2351), and (B) NLpep86 forms a complex with NLpoly11S in the presence of GWALFKK (SEQ ID NO: 2351) and Dabcyl-GWALFKK (SEQ ID NO: 2351).

Figure 203:
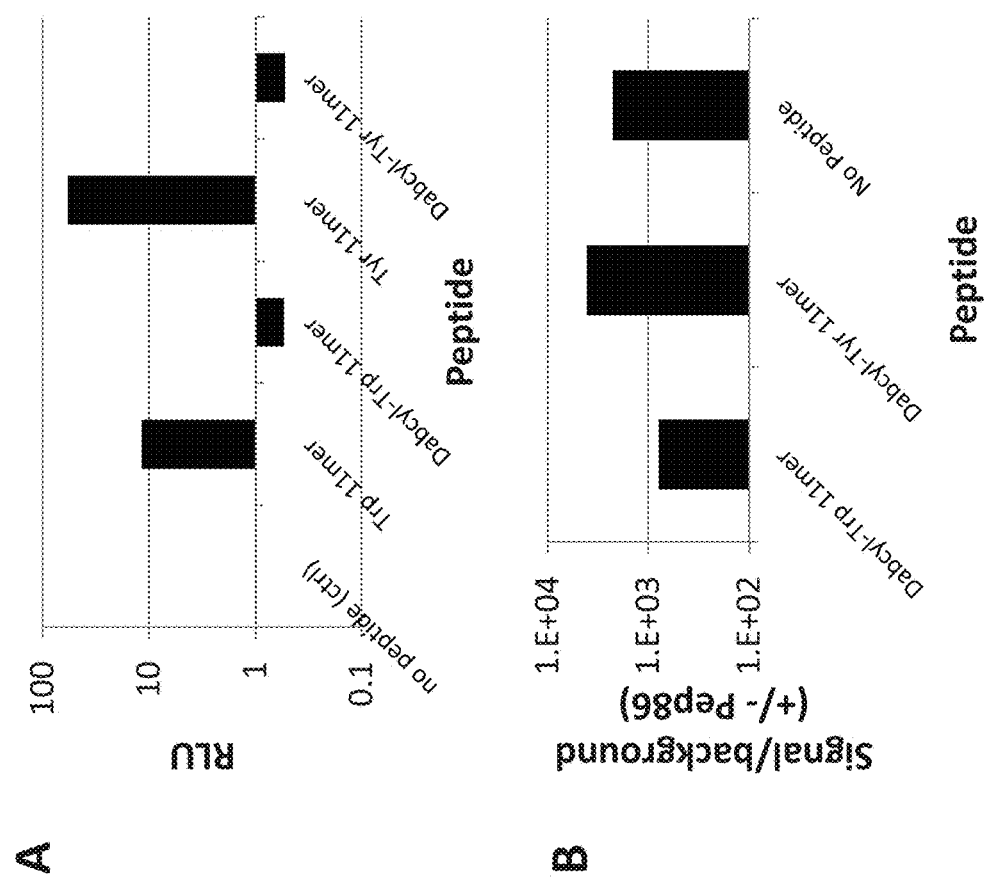

FIG. 203 shows graphs demonstrating: (A) VTGWAL-FEEIL (SEQ ID NO: 2372) (Trp 11mer) and VTGYAL-FEEIL (SEQ ID NO: 2355) (Tyr 11mer) induce luminescence over background (NLpoly11S alone: no peptide control), and that the N-terminal Dabcyl versions of each provide significant quenching of this signal, and (B) that NLpep86 forms a complex with NLpoly11S in the presence of Dabcyl versions of Trp 11mer and Tyr 11mer.

DEFINITIONS

As used herein, the term "substantially" means that the recited characteristic, parameter, and/or value need not be achieved exactly, but that deviations or variations, including for example, tolerances, measurement error, measurement accuracy limitations and other factors known to skill in the art, may occur in amounts that do not preclude the effect the characteristic was intended to provide. A characteristic or feature that is substantially absent (e.g., substantially non-luminescent) may be one that is within the noise, beneath background, below the detection capabilities of the assay being used, or a small fraction (e.g., <1%, <0.1%, <0.01%, <0.001%, <0.00001%, <0.000001%, <0.0000001%) of the significant characteristic (e.g., luminescent intensity of a bioluminescent protein or bioluminescent complex).

As used herein, the term "bioluminescence" refers to production and emission of light by a chemical reaction catalyzed by, or enabled by, an enzyme, protein, protein complex, or other biomolecule (e.g., bioluminescent complex). In typical embodiments, a substrate for a bioluminescent entity (e.g., bioluminescent protein or bioluminescent complex) is converted into an unstable form by the bioluminescent entity; the substrate subsequently emits light.

As used herein the term "complementary" refers to the characteristic of two or more structural elements (e.g., peptide, polypeptide, nucleic acid, small molecule, etc.) of being able to hybridize, dimerize, or otherwise form a complex with each other. For example, a "complementary peptide and polypeptide" are capable of coming together to form a complex. Complementary elements may require assistance to form a complex (e.g., from interaction elements), for example, to place the elements in the proper conformation for complementarity, to co-localize complementary elements, to lower interaction energy for complementary, etc.

As used herein, the term "complex" refers to an assemblage or aggregate of molecules (e.g., peptides, polypeptides, etc.) in direct and/or indirect contact with one another. In one aspect, "contact," or more particularly, "direct contact" means two or more molecules are close enough so that attractive noncovalent interactions, such as Van der Waal forces, hydrogen bonding, ionic and hydrophobic interactions, and the like, dominate the interaction of the molecules. In such an aspect, a complex of molecules (e.g., a peptide and polypeptide) is formed under assay conditions such that the complex is thermodynamically favored (e.g., compared to a non-aggregated, or non-complexed, state of its component molecules). As used herein the term "complex," unless described as otherwise, refers to the assemblage of two or more molecules (e.g., peptides, polypeptides or a combination thereof).

As used herein, the term "non-luminescent" refers to an entity (e.g., peptide, polypeptide, complex, protein, etc.) that exhibits the characteristic of not emitting a detectable amount of light in the visible spectrum (e.g., in the presence of a substrate). For example, an entity may be referred to as non-luminescent if it does not exhibit detectable luminescence in a given assay. As used herein, the term "non-luminescent" is synonymous with the term "substantially non-luminescent. For example, a non-luminescent polypeptide (NLpoly) is substantially non-luminescent, exhibiting, for example, a 10-fold or more (e.g., 100-fold, 200-fold, 500-fold, $1\times10^3$-fold, $1\times10^4$-fold, $1\times10^5$-fold, $1\times10^6$-fold, $1\times10^7$-fold, etc.) reduction in luminescence compared to a complex of the NLpoly with its non-luminescent complement peptide. In some embodiments, an entity is "non-luminescent" if any light emission is sufficiently minimal so as not to create interfering background for a particular assay.

As used herein, the terms "non-luminescent peptide" (e.g., NLpep) and "non-luminescent polypeptide" (e.g., NLpoly) refer to peptides and polypeptides that exhibit substantially no luminescence (e.g., in the presence of a substrate), or an amount that is beneath the noise, or a 10-fold or more (e.g., 100-fold, 200-fold, 500-fold, $1\times10^3$-fold, $1\times10^4$-fold, $1\times10^5$-fold, $1\times10^6$-fold, $1\times10^7$-fold, etc.) when compared to a significant signal (e.g., luminescent complex) under standard conditions (e.g., physiological conditions, assay conditions, etc.) and with typical instrumentation (e.g., luminometer, etc.). In some embodiments, such non-luminescent peptides and polypeptides assemble, according to the criteria described herein, to form a bioluminescent complex. As used herein, a "non-luminescent element" is a non-luminescent peptide or non-luminescent polypeptide. The term "bioluminescent complex" refers to the assembled complex of two or more non-luminescent peptides and/or non-luminescent polypeptides. The bioluminescent complex catalyzes or enables the conversion of a substrate for the bioluminescent complex into an unstable form; the substrate subsequently emits light. When uncomplexed, two non-luminescent elements that form a bioluminescent complex may be referred to as a "non-luminescent pair." If a bioluminescent complex is formed by three or more non-luminescent peptides and/or non-luminescent polypeptides, the uncomplexed constituents of the bioluminescent complex may be referred to as a "non-luminescent group."

As used herein, the term "interaction element" refers to a moiety that assists in bringing together a pair of non-luminescent elements or a non-luminescent group to form a bioluminescent complex. In a typical embodiment, a pair of interaction elements (a.k.a. "interaction pair") is attached to a pair of non-luminescent elements (e.g., non-luminescent peptide/polypeptide pair), and the attractive interaction between the two interaction elements facilitates formation of the bioluminescent complex; although the present invention is not limited to such a mechanism, and an understanding of the mechanism is not required to practice the invention. Interaction elements may facilitate formation of the bioluminescent complex by any suitable mechanism (e.g., bringing non-luminescent pair/group into close proximity, placing a non-luminescent pair/group in proper conformation for stable interaction, reducing activation energy for complex formation, combinations thereof, etc.). An interaction element may be a protein, polypeptide, peptide, small molecule, cofactor, nucleic acid, lipid, carbohydrate, antibody, etc. An interaction pair may be made of two of the same interaction elements (i.e. homopair) or two different interaction elements (i.e. heteropair). In the case of a heteropair, the interaction elements may be the same type of moiety (e.g., polypeptides) or may be two different types of moieties (e.g., polypeptide and small molecule). In some embodiments, in which complex formation by the interaction pair is studied, an interaction pair may be referred to as a "target pair" or a "pair of interest," and the individual interaction elements are referred to as "target elements" (e.g., "target peptide," "target polypeptide," etc.) or "elements of interest" (e.g., "peptide of interest," "polypeptide or interest," etc.).

As used herein, the term "preexisting protein" refers to an amino acid sequence that was in physical existence prior to a certain event or date. A "peptide that is not a fragment of a preexisting protein" is a short amino acid chain that is not a fragment or sub-sequence of a protein (e.g., synthetic or naturally-occurring) that was in physical existence prior to the design and/or synthesis of the peptide.

As used herein, the term "fragment" refers to a peptide or polypeptide that results from dissection or "fragmentation" of a larger whole entity (e.g., protein, polypeptide, enzyme, etc.), or a peptide or polypeptide prepared to have the same sequence as such. Therefore, a fragment is a subsequence of the whole entity (e.g., protein, polypeptide, enzyme, etc.) from which it is made and/or designed. A peptide or polypeptide that is not a subsequence of a preexisting whole protein is not a fragment (e.g., not a fragment of a preexisting protein). A peptide or polypeptide that is "not a fragment of a preexisting bioluminescent protein" is an amino acid chain that is not a subsequence of a protein (e.g., natural or synthetic) that: (1) was in physical existence prior to design and/or synthesis of the peptide or polypeptide, and (2) exhibits substantial bioluminescent activity.

As used herein, the term "subsequence" refers to peptide or polypeptide that has 100% sequence identify with another, larger peptide or polypeptide. The subsequence is a perfect sequence match for a portion of the larger amino acid chain.

As used herein, the term "sequence identity" refers to the degree two polymer sequences (e.g., peptide, polypeptide, nucleic acid, etc.) have the same sequential composition of monomer subunits. The term "sequence similarity" refers to the degree with which two polymer sequences (e.g., peptide, polypeptide, nucleic acid, etc.) have similar polymer sequences. For example, similar amino acids are those that share the same biophysical characteristics and can be grouped into the families, e.g., acidic (e.g., aspartate, glutamate), basic (e.g., lysine, arginine, histidine), non-polar (e.g., alanine, valine, leucine, isoleucine, proline, phenylalanine, methionine, tryptophan) and uncharged polar (e.g., glycine, asparagine, glutamine, cysteine, serine, threonine, tyrosine). The "percent sequence identity" (or "percent sequence similarity") is calculated by: (1) comparing two optimally aligned sequences over a window of comparison (e.g., the length of the longer sequence, the length of the shorter sequence, a specified window), (2) determining the number of positions containing identical (or similar) monomers (e.g., same amino acids occurs in both sequences, similar amino acid occurs in both sequences) to yield the number of matched positions, (3) dividing the number of matched positions by the total number of positions in the comparison window (e.g., the length of the longer sequence, the length of the shorter sequence, a specified window), and (4) multiplying the result by 100 to yield the percent sequence identity or percent sequence similarity. For example, if peptides A and B are both 20 amino acids in length and have identical amino acids at all but 1 position, then peptide A and peptide B have 95% sequence identity. If the amino acids at the non-identical position shared the same biophysical characteristics (e.g., both were acidic), then peptide A and peptide B would have 100% sequence similarity. As another example, if peptide C is 20 amino acids in length and peptide D is 15 amino acids in length, and 14 out of 15 amino acids in peptide D are identical to those of a portion of peptide C, then peptides C and D have 70% sequence identity, but peptide D has 93.3% sequence identity to an optimal comparison window of peptide C. For the purpose of calculating "percent sequence identity" (or "percent sequence similarity") herein, any gaps in aligned sequences are treated as mismatches at that position.

As used herein, the term "physiological conditions" encompasses any conditions compatible with living cells, e.g., predominantly aqueous conditions of a temperature, pH, salinity, chemical makeup, etc. that are compatible with living cells.

As used herein, the term "sample" is used in its broadest sense. In one sense, it is meant to include a specimen or culture obtained from any source, as well as biological and environmental samples. Biological samples may be obtained from animals (including humans) and encompass fluids, solids, tissues, and gases. Biological samples include blood products, such as plasma, serum and the like. Sample may also refer to cell lysates or purified forms of the peptides and/or polypeptides described herein. Cell lysates may include cells that have been lysed with a lysing agent or lysates such as rabbit reticulocyte or wheat germ lysates. Sample may also include cell-free expression systems. Environmental samples include environmental material such as surface matter, soil, water, crystals and industrial samples. Such examples are not however to be construed as limiting the sample types applicable to the present invention.

As used herein, unless otherwise specified, the terms "peptide" and "polypeptide" refer to polymer compounds of two or more amino acids joined through the main chain by peptide amide bonds (—C(O)NH—). The term "peptide" typically refers to short amino acid polymers (e.g., chains having fewer than 25 amino acids), whereas the term "polypeptide" typically refers to longer amino acid polymers (e.g., chains having more than 25 amino acids).

DETAILED DESCRIPTION

The study of protein interactions, particularly under physiological conditions and/or at physiologic expression levels, requires high sensitivity. In particular embodiments described herein, protein interactions with small molecules, nucleic acids, other proteins, etc. are detected based on the association of two non-luminescent elements that come together to from a bioluminescent complex capable of producing a detectable signal (e.g., luminescence). The formation of the bioluminescent complex is dependent upon the protein interaction that is being monitored.

Provided herein are compositions and methods for the assembly of a bioluminescent complex from two or more non-luminescent peptide and/or polypeptide units (e.g., non-luminescent pair). In some embodiments, the non-luminescent peptide and/or polypeptide units are not fragments of a preexisting protein (e.g., are not complementary subsequences of a known polypeptide sequence). In particular, bioluminescent activity is conferred upon a non-luminescent polypeptide via structural complementation with a non-luminescent peptide.

In some embodiments, provided herein are non-luminescent pairs for use in detecting and monitoring molecular interactions (e.g., protein-protein, protein-DNA, protein-RNA interactions, RNA-DNA, protein-small molecule, RNA-small-molecule, etc.). Also provided herein are complementary panels of interchangeable non-luminescent elements (e.g., peptides and polypeptides) that have variable affinities and luminescence upon formation of the various bioluminescent complexes (e.g., a high-affinity/high-luminescence pair, a moderate-affinity/high-luminescence pair, a low-affinity/moderate-luminescence pair, etc.). Utilizing different combinations of non-luminescent elements provides an adaptable system comprising various pairs ranging from lower to higher affinities, luminescence and other variable characteristics. This adaptability allows the detection/monitoring of molecular interactions to be fine-tuned to the specific molecule(s) of interest and expands the range of molecular interactions that can be monitored to include interactions with very high or low affinities. Further provided herein are methods by which non-luminescent pairs (or groups) and panels of non-luminescent pairs (or groups) are developed and tested.

In some embodiments, the interaction between the peptide/polypeptide members of the non-luminescent pair alone is insufficient to form the bioluminescent complex and produce the resulting bioluminescent signal. However, if an interaction element is attached to each peptide/polypeptide member of the non-luminescent pair, then the interactions of the interaction pair (e.g., to form an interaction complex) facilitate formation of the bioluminescent complex. In such embodiments, the bioluminescent signal from the bioluminescent complex (or the capacity to produce such a signal in the presence of substrate) serves as a reporter for the formation of the interaction complex. If an interaction complex is formed, then a bioluminescent complex is formed, and a bioluminescent signal is detected/measured/monitored (e.g., in the presence of substrate). If an interaction complex fails to form (e.g., due to unfavorable conditions, due to unstable interaction between the interaction elements, due to incompatible interaction elements), then a bioluminescent complex does not form, and a bioluminescent signal is not produced.

In certain embodiments, the interaction pair comprises two molecules of interest (e.g., proteins of interest). For example, assays can be performed to detect the interaction of two molecules of interest by tethering each one to a separate member of a non-luminescent pair. If the molecules of interest interact (e.g., transiently interact, stably interact, etc.), the non-luminescent pair is brought into close proximity in a suitable conformation and a bioluminescent complex is formed (and bioluminescent signal is produced/detected (in the presence of substrate)). In the absence of an interaction between the molecules of interest (e.g., no complex formation, not even transient interaction, etc.), the non-luminescent pair does not interact in a sufficient manner, and a bioluminescent signal is not produced or only weakly produced. Such embodiments can be used to study the effect of inhibitors on complex formation, the effect of mutations on complex formation, the effect of conditions (e.g., temperature, pH, etc.) on complex formation, the interaction of a small molecule (e.g., potential therapeutic) with a target molecule, etc.

Different non-luminescent pairs may require different strength, duration and/or stability of the interaction complex to result in bioluminescent complex formation. In some embodiments, a stable interaction complex is required to produce a detectable bioluminescent signal. In other embodiments, even a weak or transient interaction complex results in bioluminescent complex formation. In some embodiments, the strength or extent of an interaction complex is directly proportional to the strength of the resulting bioluminescent signal. Some non-luminescent pairs produce a detectable signal when combined with an interaction complex with a high millimolar dissociation constant (e.g., $K_d > 100$ mM). Other non-luminescent pairs require an interaction pair with a low millimolar (e.g., $K_d < 100$ mM), micromolar (e.g., $K_d < 1$ mM), nanomolar (e.g., $K_d < 1$ μM), or even picomolar (e.g., $K_d < 1$ nM) dissociation constant in order to produce a bioluminescent complex with a detectable signal.

In some embodiments, one or more of the non-luminescent peptides/polypeptides are not fragments of a pre-existing protein. In some embodiments, one or more of the non-luminescent peptides/polypeptides are not fragments of a pre-existing bioluminescent protein. In some embodiments, neither/none of the non-luminescent peptides/polypeptides are fragments of a pre-existing protein. In some embodiments, neither/none of the non-luminescent peptides/polypeptides are fragments of a pre-existing bioluminescent protein. In some embodiments, neither the non-luminescent peptide nor non-luminescent polypeptide that assemble together to form a bioluminescent complex are fragments of a pre-existing protein. In some embodiments, a non-luminescent element for use in embodiments of the present invention is not a subsequence of a preexisting protein. In some embodiments, a non-luminescent pair for use in embodiments described herein does not comprise complementary subsequences of a preexisting protein.

In some embodiments, non-luminescent peptides/polypeptides are substantially non-luminescent in isolation. In certain embodiments, when placed in suitable conditions (e.g., physiological conditions), non-luminescent peptides/polypeptides interact to form a bioluminescent complex and produce a bioluminescent signal in the presence of substrate. In other embodiments, without the addition of one or more interaction elements (e.g., complementary interaction elements attached to the component non-luminescent peptide and non-luminescent polypeptide), non-luminescent peptides/polypeptides are unable to form a bioluminescent complex or only weakly form a complex. In such embodiments, non-luminescent peptides/polypeptides are substantially non-luminescent in each other's presence alone, but produce significant detectable luminescence when aggregated, associated, oriented, or otherwise brought together by interaction elements. In some embodiments, without the addition of one or more interaction elements (e.g., complementary interaction elements attached to the component peptide and polypeptide), peptides and/or polypeptides that assemble into the bioluminescent complex produce a low level of luminescence in each other's presence, but undergo a significant increase in detectable luminescence when aggregated, associated, oriented, or otherwise brought together by interaction elements.

In some embodiments, compositions and methods described herein comprise one or more interaction elements. In a typical embodiment, an interaction element is a moiety (e.g., peptide, polypeptide, protein, small molecule, nucleic acid, lipid, carbohydrate, etc.) that is attached to a peptide and/or polypeptide to assemble into the bioluminescent complex. The interaction element facilitates the formation of a bioluminescent complex by any suitable mechanism, including: interacting with one or both non-luminescent elements, inducing a conformational change in a non-luminescent element, interacting with another interaction element (e.g., an interaction element attached to the other non-luminescent element), bringing non-luminescent elements into close proximity, orienting non-luminescent elements for proper interaction, etc.

In some embodiments, one or more interaction elements are added to a solution containing the non-luminescent elements, but are not attached to the non-luminescent elements. In such embodiments, the interaction element(s) interact with the non-luminescent elements to induce formation of the bioluminescent complex or create conditions suitable for formation of the bioluminescent complex. In other embodiments, a single interaction element is attached to one member of a non-luminescent pair. In such embodiments, the lone interaction element interacts with one or both of the non-luminescent elements to create favorable interactions for formation of the bioluminescent complex. In typical embodiments of the present invention, one interaction element is attached to each member of a non-luminescent pair. Favorable interactions between the interaction elements facilitate interactions between the non-luminescent elements. The interaction pair may stably interact, transiently interact, form a complex, etc. The interaction of the interaction pair facilitates interaction of the non-luminescent elements (and formation of a bioluminescent complex) by any suitable mechanism, including, but not limited to: bringing the non-luminescent pair members into close proximity, properly orienting the non-luminescent pair members from interaction, reducing non-covalent forces acting against non-luminescent pair interaction, etc.

In some embodiments, an interaction pair comprises any two chemical moieties that facilitate interaction of an associated non-luminescent pair. An interaction pair may consist of, for example: two complementary nucleic acids, two polypeptides capable of dimerization (e.g., homodimer, heterodimer, etc.), a protein and ligand, protein and small molecule, an antibody and epitope, a reactive pair of small molecules, etc. Any suitable pair of interacting molecules may find use as an interaction pair.

In some embodiments, an interaction pair comprises two molecules of interest (e.g., proteins of interest) or target molecules. In some embodiments, compositions and methods herein provide useful assays (e.g., in vitro, in vivo, in situ, whole animal, etc.) for studying the interactions between a pair of target molecules.

In certain embodiments, a pair off interaction elements, each attached to one of the non-luminescent elements, interact with each other and thereby facilitate formation of the bioluminescent complex. In some embodiments, the presence of a ligand, substrate, co-factor or addition interaction element (e.g., not attached to non-luminescent element) is necessary to induce the interaction between the interaction elements and facilitate bioluminescent complex formation. In some embodiments, detecting a signal from the bioluminescent complex indicates the presence of the ligand, substrate, co-factor or addition interaction element or conditions that allow for interaction with the interaction elements.

In some embodiments, a pair off interaction elements, and a pair of non-luminescent elements are all present in a single amino acid chain (e.g., (interaction element 1)-NLpep-(interaction element 2)-NLpoly, NLpoly-(interaction element 1)-NLpep-(interaction element 2), NLpoly-(interaction element 1)-(interaction element 2)-NLpep, etc.). In some embodiments in which a pair off interaction elements, and a pair of non-luminescent elements are all present in a single amino acid chain, a ligand, substrate, co-factor or addition interaction element is required for the interaction pair to form an interaction complex and facilitate formation of the bioluminescent complex.

In certain embodiments, an interaction element and a non-luminescent element are attached, fused, linked, connected, etc. In typical embodiments, a first non-luminescent element and a first interaction element are attached to each other, and a second non-luminescent element and a second interaction element are attached to each other. Attachment of signal and interaction elements may be achieved by any suitable mechanism, chemistry, linker, etc. The interaction and non-luminescent elements are typically attached through covalent connection, but non-covalent linking of the two elements is also provided. In some embodiments, the signal and interaction elements are directly connected and, in other embodiments, they are connected by a linker.

In some embodiments, in which the interaction element is a peptide or polypeptide, the signal and interaction elements are contained within a single amino acid chain. In some embodiments, a single amino acid chain comprises, consists of, or consists essentially of a non-luminescent element and interaction element. In some embodiments, a single amino acid chain comprises, consists of, or consists essentially of a non-luminescent element, an interaction element, and optionally one or more an N-terminal sequence, a C-terminal sequence, regulatory elements (e.g., promoter, translational start site, etc.), and a linker sequence. In some embodiments, the signal and interaction elements are contained within a fusion polypeptide. The signal and interaction elements (and any other amino acid segments to be included in the fusion) may be expressed separately; however, in other embodiments, a fusion protein is expressed that comprises or consist of both the interaction and signal sequences.

In some embodiments, a first fusion protein comprising a first non-luminescent element and first interaction element as well as a second fusion protein comprising a second non-luminescent element and second interaction element are expressed within the same cells. In such embodiments, the first and second fusion proteins are purified and/or isolated from the cells, or the interaction of the fusion proteins is assayed within the cells. In other embodiments, first and second fusion proteins are expressed in separate cells and combined (e.g., following purification and/or isolation, or following fusion of the cells or portions of the cells, or by transfer of a fusion protein from one cell to another, or by secretion of one or more fusion proteins into the extracellular medium) for signal detection. In some embodiments, one or more fusion proteins are expressed in cell lysate (e.g., rabbit reticulocyte lysate) or in a cell-free system. In some embodiments, one or more fusion proteins are expressed from the genome of a virus or other cellular pathogen.

In certain embodiments, nucleic acids, DNA, RNA, vectors, etc. are provided that encode peptide, polypeptides, fusion polypeptide, fusion proteins, etc. of the present invention. Such nucleic acids and vectors may be used for expression, transformation, transfection, injection, etc.

In some embodiments, a non-luminescent element and interaction element are connected by a linker. In some embodiments, a linker connects the signal and interaction elements while providing a desired amount of space/distance between the elements. In some embodiments, a linker allows both the signal and interaction elements to form their respective pairs (e.g., non-luminescent pair and interaction pair) simultaneously. In some embodiments, a linker assists the interaction element in facilitating the formation of a non-luminescent pair interaction. In some embodiments, when an interaction pair is formed, the linkers that connect each non-luminescent element to their respective interaction elements position the non-luminescent elements at the proper distance and conformation to form a bioluminescent complex. In some embodiments, an interaction element and non-luminescent element are held in close proximity (e.g., <4 monomer units) by a linker. In some embodiments, a linker provides a desired amount of distance (e.g., 1, 2, 3, 4, 5, 6 . . . 10 . . . 20, or more monomer units) between signal and interaction elements (e.g., to prevent undesirable interactions between signal and interaction elements, for steric considerations, to allow proper orientation of non-luminescent element upon formation of interaction complex, to allow propagation of a complex-formation from interaction complex to non-luminescent elements, etc.). In certain embodiments, a linker provides appropriate attachment chemistry between the signal and interaction elements. A linker may also improve the synthetic process of making the signal and interaction element (e.g., allowing them to be synthesized as a single unit, allowing post synthesis connection of the two elements, etc.).

In some embodiments, a linker is any suitable chemical moiety capable of linking, connecting, or tethering a non-luminescent element to an interaction element. In some embodiments, a linker is a polymer of one or more repeating or non-repeating monomer units (e.g., nucleic acid, amino acid, carbon-containing polymer, carbon chain, etc.). When a non-luminescent element and interaction element are part of a fusion protein, a linker (when present) is typically an amino acid chain. When a non-luminescent element and interaction element are tethered together after the expression of the individual elements, a linker may comprise any chemical moiety with functional (or reactive) groups at either end that are reactive with functional groups on the signal and interaction elements, respectively. Any suitable moiety capable of tethering the signal and interaction elements may find use as a linker.

A wide variety of linkers may be used. In some embodiments, the linker is a single covalent bond. In some embodiments, the linker comprises a linear or branched, cyclic or heterocyclic, saturated or unsaturated, structure having 1-20 nonhydrogen atoms (e.g., C, N, P, O and S) and is composed of any combination of alkyl, ether, thioether, imine, carboxvlic, amine, ester, carboxamide, sulfonamide, hydrazide bonds and aromatic or heteroaromatic bonds. In some embodiments, linkers are longer than 20 nonhydrogen atoms (e.g. 21 non-hydrogen atoms, 25 non-hydrogen atoms, 30 non-hydrogen atoms, 40 non-hydrogen atoms, 50 non-hydrogen atoms, 100 non-hydrogen atoms, etc.) In some embodiments, the linker comprises 1-50 non-hydrogen atoms (in addition to hydrogen atoms) selected from the group of C, N, P. O and S (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40.41, 42, 43, 44, 45, 46, 47, 48, 49, or 50 non-hydrogen atoms).

The present invention is not limited by the types of linkers available. The signal and interaction elements are linked, either directly (e.g. linker consists of a single covalent bond) or linked via a suitable linker. The present invention is not limited to any particular linker group. A variety of linker groups are contemplated, and suitable linkers could comprise, but are not limited to, alkyl groups, methylene carbon chains, ether, polyether, alkyl amide linker, a peptide linker, a modified peptide linker, a Poly(ethylene glycol) (PEG) linker, a streptavidin-biotin or avidin-biotin linker, polyaminoacids (e.g. polylysine), functionalised PEG, polysaccharides, glycosaminoglycans, dendritic polymers (WO93/06868 and by Tomalia et al. in Angew. Chem. Int. Ed. Engl. 29:138-175 (1990), herein incorporated by reference in their entireties), PEG-chelant polymers (W94/08629, WO94/09056 and WO96/26754, herein incorporated by reference in their entireties), oligonucleotide linker, phospholipid derivatives, alkenyl chains, alkynyl chains, disulfide, or a combination thereof. In some embodiments, the linker is cleavable (e.g., enzymatically (e.g., TEV protease site), chemically, photoinduced, etc.

In some embodiments, substantially non-luminescent peptides and polypeptides are provided with less than 100% sequence identity and/or similarity to any portion of an existing luciferase (e.g., a firefly luciferase, a *Renilla* luciferase, an Oplophorus luciferase, enhanced Oplophorus luciferases as described in U.S. Pat. App. 2010/0281552 and U.S. Pat. App. 2012/0174242, herein incorporated by reference in their entireties). Certain embodiments of the present invention involve the formation of bioluminescent complexes of non-luminescent peptides and polypeptides with less than 100% sequence identity with all or a portion (e.g., 8 or more amino acids, less than about 25 amino acids for peptides) of SEQ ID NO: 2157 (e.g., complete NANOLUC sequence). Certain embodiments of the present invention involve the formation of bioluminescent complexes of non-luminescent peptides and polypeptides with less than 100%, but more than 40% (e.g., >40%, >45%, >50%, >55%, >60%, >65%, >70%, >75%, >80%, >85%, >90%, >95%, >98%, >996%) sequence identity with all or a portion (e.g., 8 or more amino acids, less than about 25 amino acids for peptides) of SEQ ID NO: 2157 (e.g., complete NANOLUC sequence). In some embodiments, non-luminescent peptides and polypeptides are provided with less than 1000/sequence similarity with a portion (e.g., 8 or more amino acids, less than about 25 amino acids for peptides) of SEQ ID NO: 2157 (e.g., peptides and polypeptides that interact to form bioluminescent complexes). In some embodiments, non-luminescent peptides and polypeptides are provided with less than 100%, but more than 406 (e.g., >40%, >45%, >50%, >55%, >60%, >65%, >70%, >75%, >80%, >85%, >90%, >95%, >98%, >99%) sequence similarity with a portion (e.g., 8 or more amino acids, less than about 25 amino acids for peptides) of SEQ ID NO: 2157 (e.g., peptides and polypeptides that interact to form bioluminescent complexes). Non-luminescent peptides are provided that have less than 100% sequence identity and/or similarity with about a 25 amino acid or less portion of SEQ ID NO: 2157, wherein such peptides form a bioluminescent complex when combined under appropriate conditions (e.g., stabilized by an interaction pair) with a polypeptide having less than 100%, but more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 2157. Non-luminescent peptides are provided that have less than 100% sequence identity and/or similarity with about a 25 amino acid or less portion of SEQ ID NO: 2157, wherein such peptides form a bioluminescent complex when combined under appropriate conditions (e.g., stabilized by an interaction pair) with a polypeptide having less than 100%, but more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 2157. Non-luminescent peptides are provided that have less than 100%, but more than 40% (e.g., >40%, >45%, >50%, >55%, >60%, >65%, >70%, >75%, >80%, >85%, >90%, >95%, >98%, >99%) sequence identity and/or similarity with about a 25 amino acid or less portion of SEQ ID NO: 2157, wherein such peptides form a bioluminescent complex when combined under appropriate conditions (e.g., stabilized by an interaction pair) with a polypeptide having less than 100%, but more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 2157. Similarly, non-luminescent polypeptides are provided that have less than 100%, but more than 40% (e.g., >40%, >45%, >50%, >55%, >60%, >65%, >70%, >75%, >80%, >85%, >90%, >95%, >98%, >99%) sequence identity or similarity with a portion of SEQ ID NO: 2157, wherein such polypeptides form a bioluminescent complex when combined under appropriate conditions (e.g., stabilized by an interaction pair) with a peptide having less than 100%, but optionally more than 40% (e.g., >40%, >45%, >50%, >55%, >60%, >65%, >70%, >75%, >80%, >85%, >90%, >95%, >98%, >99%) sequence identity and/or similarity with another portion SEQ ID NO: 2157. In some embodiments, non-luminescent peptides with less than 100 sequence identity or similarity with SEQ ID NO: 2 are provided. In some embodiments, non-luminescent peptides with less than 100%, but more than 40% (e.g., >40%, >45%, >50%, >55%, >60%, >65%, >70%, >75%, >80%, >85%, >90%, >95%, >98%, >99%6) sequence identity or similarity with SEQ ID NO: 2 are provided. In some embodiments, non-luminescent polypeptides with less than 100 sequence identity or similarity with SEQ ID NO: 440 are provided.

In some embodiments, non-luminescent polypeptides with less than 100%, but more than 40% (e.g., >40%, >45%, >50%, >55%, >60%, >65%, >70%, >75%, >80%, >85%, >90%, >95%, >98%, >99%) sequence identity or similarity with SEQ ID NO: 440 are provided.

In some embodiments, non-luminescent peptides that find use in embodiments of the present invention include peptides with one or more amino acid substitutions, deletions, or additions from GVTGWRLCKRISA (SEQ ID NO: 236). In some embodiments, the present invention provides peptides comprising one or more of amino acid sequences of Table 1, and/or nucleic acids comprising the nucleic acid sequences of Table 1 (which code for the peptide sequences of Table 1).

TABLE 1

Peptide sequences

| SEQ ID NO. | PEPTIDE NO. | POLYMER | SEQUENCE |
|---|---|---|---|
| 3 | NLpep2 (w/ Met) | N.A. | ATGGACGTGACCGGCTGGCGGCTGTGCGAACGCATTCTGGCG |
| 4 | NLpep2 (w/ Met) | A.A. | MDVTGWRLCERILA |
| 5 | NLpep3 (w/ Met) | N.A. | ATGGGAGTGACCGCCTGGCGGCTGTGCGAACGCATTCTGGCG |
| 6 | NLpep3 (w/ Met) | A.A. | MGVTAWRLCERILA |
| 7 | NLpep4 (w/ Met) | N.A. | ATGGGAGTGACCGGCTGGCGGCTGTGCAAGCGCATTCTGGCG |
| 8 | NLpep4 (w/ Met) | A.A. | MGVTGWRLCKRILA |
| 9 | NLpep5 (w/ Met) | N.A. | ATGGGAGTGACCGGCTGGCGGCTGTGCGAACGCATTAGCGCG |
| 10 | NLpep5 (w/ Met) | A.A. | MGVTGWRLCERISA |
| 11 | NLpep6 (w/ Met) | N.A. | ATGGACGTGACCGGCTGGCGGCTGTGCAAGCGCATTAGCGCG |
| 12 | NLpep6 (w/ Met) | A.A. | MDVTGWRLCKRISA |
| 13 | NLpep7 (w/ Met) | N.A. | ATGGACGTGACCGGCTGGCGGCTGTGCAAGCGCATTCTGGCG |
| 14 | NLpep7 (w/ Met) | A.A. | MDVTGWRLCKRILA |
| 15 | NLpep8 (w/ Met) | N.A. | ATGGACGTGACCGGCTGGCGGCTGTGCGAACGCATTAGCGCG |
| 16 | NLpep8 (w/ Met) | A.A. | MDVTGWRLCERISA |
| 17 | NLpep9 (w/ Met) | N.A. | ATGGGAGTGACCGGCTGGCGGCTGTGCAAGCGCATTAGCGCG |
| 18 | NLpep9 (w/ Met) | A.A. | MGVTGWRLCKRISA |
| 19 | NLpep10 (w/ Met) | N.A. | ATGGGAGTGACCGGCTGGCGGCTGAACGAACGCATTCTGGCG |
| 20 | NLpep10 (w/ Met) | A.A. | MGVTGWRLNERILA |
| 21 | NLpep11 (w/ Met) | N.A. | ATGGGAGTGACCGGCTGGCGGCTGCAGGAACGCATTCTGGCG |
| 22 | NLpep11 (w/ Met) | A.A. | MGVTGWRLQERILA |
| 23 | NLpep12 (w/ Met) | N.A. | ATGGGAGTGACCGGCTGGCGGCTGAAGAAGCGCCGGAGCCGG |
| 24 | NLpep12 (w/ Met) | A.A. | MGVTGWRLKKRRSR |
| 25 | NLpep13 (w/ Met) | N.A. | ATGAACGTGACCGGCTGGCGGCTGTGCAAGCGCATTAGCGCG |
| 26 | NLpep13 (w/ Met) | A.A. | MNVTGWRLCKRISA |
| 27 | NLpep14 (w/ Met) | N.A. | ATGAGCGTGACCGGCTGGCGGCTGTGCAAGCGCATTAGCGCG |
| 28 | NLpep14 (w/ Met) | A.A. | MSVTGWRLCKRISA |
| 29 | NLpep15 (w/ Met) | N.A. | ATGGAGGTGACCGGCTGGCGGCTGTGCAAGCGCATTAGCGCG |
| 30 | NLpep15 (w/ Met) | A.A. | MEVTGWRLCKRISA |
| 31 | NLpep16 (w/ Met) | N.A. | ATGGGCGTGACCGGCTGGCGGCTGTGCAAGCGCATTAGCGCG |
| 32 | NLpep16 (w/ Met) | A.A. | MHVTGWRLCKRISA |

TABLE 1-continued

Peptide sequences

| SEQ ID NO. | PEPTIDE NO. | POLYMER | SEQUENCE |
|---|---|---|---|
| 33 | NLpep17 (w/ Met) | N.A. | ATGGGACACACCGGCTGGCGGCTGTGCAAGCGCATTAGCGCG |
| 34 | NLpep17 (w/ Met) | A.A. | MGITGWRLCKRISA |
| 35 | NLpep18 (w/ Met) | N.A. | ATGGGAGCCACCGGCTGGCGGCTGTGCAAGCGCATTAGCGCG |
| 36 | NLpep18 (w/ Met) | A.A. | MGATGWRLCKRISA |
| 37 | NLpep19 (w/ Met) | N.A. | ATGGGAAAGACCGGCTGGCGGCTGTGCAAGCGCATTAGCGCG |
| 38 | NLpep19 (w/ Met) | A.A. | MGKTGWRLCKRISA |
| 39 | NLpep20 (w/ Met) | N.A. | ATGGGACAGACCGGCTGGCGGCTGTGCAAGCGCATTAGCGCG |
| 40 | NLpep20 (w/ Met) | A.A. | MGQTGWRLCKRISA |
| 41 | NLpep21 (w/ Met) | N.A. | ATGGGAAGCACCGGCTGGCGGCTGTGCAAGCGCATTAGCGCG |
| 42 | NLpep21 (w/ Met) | A.A. | MGSTGWRLCKRISA |
| 43 | NLpep22 (w/ Met) | N.A. | ATGGGAGTGGTGGGCTGGCGGCTGTGCAAGCGCATTAGCGCG |
| 44 | NLpep22 (w/ Met) | A.A. | MGVVGWRLCKRISA |
| 45 | NLpep23 (w/ Met) | N.A. | ATGGGAGTGAAGGGCTGGCGGCTGTGCAAGCGCATTAGCGCG |
| 46 | NLpep23 (w/ Met) | A.A. | MGVKGWRLCKRISA |
| 47 | NLpep24 (w/ Met) | N.A. | ATGGGAGTGCAGGGCTGGCGGCTGTGCAAGCGCATTAGCGCG |
| 48 | NLpep24 (w/ Met) | A.A. | MGVQGWRLCKRISA |
| 49 | NLpep25 (w/ Met) | N.A. | ATGGGAGTGACCGGCACCCGGCTGTGCAAGCGCATTAGCGCG |
| 50 | NLpep25 (w/ Met) | A.A. | MGVTGTRLCKRISA |
| 51 | NLpep26 (w/ Met) | N.A. | ATGGGAGTGACCGGCAAGCGGCTGTGCAAGCGCATTAGCGCG |
| 52 | NLpep26 (w/ Met) | A.A. | MGVTGKRLCKRISA |
| 53 | NLpep27 (w/ Met) | N.A. | ATGGGAGTGACCGGCGTGCGGCTGTGCAAGCGCATTAGCGCG |
| 54 | NLpep27 (w/ Met) | A.A. | MGVTGVRLCKRISA |
| 55 | NLpep28 (w/ Met) | N.A. | ATGGGAGTGACCGGCTGGCGGCACTGCAAGCGCATTAGCGCG |
| 56 | NLpep28 (w/ Met) | A.A. | MGVTGWRICKRISA |
| 57 | NLpep29 (w/ Met) | N.A. | ATGGGAGTGACCGGCTGGCGGGTGTGCAAGCGCATTAGCGCG |
| 58 | NLpep29 (w/ Met) | A.A. | MGVTGWRVCKRISA |
| 59 | NLpep30 (w/ Met) | N.A. | ATGGGAGTGACCGGCTGGCGGACCTGCAAGCGCATTAGCGCG |
| 60 | NLpep30 (w/ Met) | A.A. | MGVTGWRTCKRISA |
| 61 | NLpep31 (w/ Met) | N.A. | ATGGGAGTGACCGGCTGGCGGTACTGCAAGCGCATTAGCGCG |

TABLE 1-continued

Peptide sequences

| SEQ ID NO. | PEPTIDE NO. | POLYMER | SEQUENCE |
|---|---|---|---|
| 62 | NLpep31 (w/ Met) | A.A. | MGVTGWRYCKRISA |
| 63 | NLpep32 (w/ Met) | N.A. | ATGGGAGTGACCGGCTGGCGGAAGTGCAAGCGCATTAGCGCG |
| 64 | NLpep32 (w/ Met) | A.A. | MGVTGWRKCKRISA |
| 65 | NLpep33 (w/ Met) | N.A. | ATGGGAGTGACCGGCTGGCGGCTGAACAAGCGCATTAGCGCG |
| 66 | NLpep33 (w/ Met) | A.A. | MGVTGWRLNKRISA |
| 67 | NLpep34 (w/ Met) | N.A. | ATGGGAGTGACCGGCTGGCGGCTGACCAAGCGCATTAGCGCG |
| 68 | NLpep34 (w/ Met) | A.A. | MGVTGWRLTKRISA |
| 69 | NLpep35 (w/ Met) | N.A. | ATGGGAGTGACCGGCTGGCGGCTGTGCAAGAAGATTAGCGCG |
| 70 | NLpep35 (w/ Met) | A.A. | MGVTGWRLCKKISA |
| 71 | NLpep36 (w/ Met) | N.A. | ATGGGAGTGACCGGCTGGCGGCTGTGCAAGAACATTAGCGCG |
| 72 | NLpep36 (w/ Met) | A.A. | MGVTGWRLCKNISA |
| 73 | NLpep37 (w/ Met) | N.A. | ATGGGAGTGACCGGCTGGCGGCTGTGCAAGCGCGTGAGCGCG |
| 74 | NLpep37 (w/ Met) | A.A. | MGVTGWRLCKRVSA |
| 75 | NLpep38 (w/ Met) | N.A. | ATGGGAGTGACCGGCTGGCGGCTGTGCAAGCGCCAGAGCGCG |
| 76 | NLpep38 (w/ Met) | A.A. | MGVTGWRLCKRQSA |
| 77 | NLpep39 (w/ Met) | N.A. | ATGGGAGTGACCGGCTGGCGGCTGTGCAAGCGCGAGAGCGCG |
| 78 | NLpep39 (w/ Met) | A.A. | MGVTGWRLCKRESA |
| 79 | NLpep40 (w/ Met) | N.A. | ATGGGAGTGACCGGCTGGCGGCTGTGCAAGCGCCGGAGCGCG |
| 80 | NLpep40 (w/ Met) | A.A. | MGVTGWRLCKRRSA |
| 81 | NLpep41 (w/ Met) | N.A. | ATGGGAGTGACCGGCTGGCGGCTGTGCAAGCGCTTCAGCGCG |
| 82 | NLpep41 (w/ Met) | A.A. | MGVTGWRLCKRFSA |
| 83 | NLpep42 (w/ Met) | N.A. | ATGGGAGTGACCGGCTGGCGGCTGTGCAAGCGCATTAGCAAC |
| 84 | NLpep42 (w/ Met) | A.A. | MGVTGWRLCKRISN |
| 85 | NLpep43 (w/ Met) | N.A. | ATGGGAGTGACCGGCTGGCGGCTGTGCAAGCGCATTAGCACC |
| 86 | NLpep43 (w/ Met) | A.A. | MGVTGWRLCKRIST |
| 87 | NLpep44 (w/ Met) | N.A. | ATGGGAGTGACCGGCTGGCGGCTGTGCAAGCGCATTAGCCGG |
| 88 | NLpep44 (w/ Met) | A.A. | MGVTGWRLCKRISR |
| 89 | NLpep45 (w/ Met) | N.A. | ATGGGAGTGACCGGCTGGCGGCTGTGCAAGCGCATTAGCCTG |
| 90 | NLpep45 (w/ Met) | A.A. | MGVTGWRLCKRISL |
| 91 | NLpep46 (w/ Met) | N.A. | ATGGGAGTGACCGGCTGGCGGCTGTGCAAGCGCATTAGCGAG |

TABLE 1-continued

Peptide sequences

| SEQ ID NO. | PEPTIDE NO. | POLYMER | SEQUENCE |
|---|---|---|---|
| 92 | NLpep46 (w/ Met) | A.A. | MGVTGWRLCKRISE |
| 93 | NLpep47 (w/ Met) | N.A. | ATGGGAGTGACCGGCTTCCGGCTGTGCAAGCGCATTAGCGCG |
| 94 | NLpep47 (w/ Met) | A.A. | MGVTGFRLCKRISA |
| 95 | NLpep48 (w/ Met) | N.A. | ATGGGAGTGACCGGCTACCGGCTGTGCAAGCGCATTAGCGCG |
| 96 | NLpep48 (w/ Met) | A.A. | MGVTGYRLCKRISA |
| 97 | NLpep49 (w/ Met) | N.A. | ATGGGAGTGACCGGCGAGCGGCTGTGCAAGCGCATTAGCGCG |
| 98 | NLpep49 (w/ Met) | A.A. | MGVTGERLCKRISA |
| 99 | NLpep50 (w/ Met) | N.A. | ATGCAGGTGACCGGCTGGCGGCTGTGCAAGCGCATTAGCGCG |
| 100 | NLpep50 (w/ Met) | A.A. | MQVTGWRLCKRISA |
| 101 | NLpep51 (w/ Met) | N.A. | ATGACCGTGACCGGCTGGCGGCTGTGCAAGCGCATTAGCGCG |
| 102 | NLpep51 (w/ Met) | A.A. | MTVTGWRLCKRISA |
| 103 | NLpep52 (w/ Met) | N.A. | ATGGGAGTGGAGGGCTGGCGGCTGTGCAAGCGCATTAGCGCG |
| 104 | NLpep52 (w/ Met) | A.A. | MGVEGWRLCKRISA |
| 105 | NLpep53 (w/ Met) | N.A. | ATGGGAGTGACCGGCTGGCGGCTGTTCAAGCGCATTAGCGCG |
| 106 | NLpep53 (w/ Met) | A.A. | MGVTGWRLFKRISA |
| 107 | NLpep54 (w/ Met) | N.A. | ATGGGAGTGACCGGCTGGCGGCTGTACAAGCGCATTAGCGCG |
| 108 | NLpep54 (w/ Met) | A.A. | MGVTGWRLYKRISA |
| 109 | NLpep55 (w/ Met) | N.A. | ATGGGAGTGACCGGCTGGCGGCTGAGCAAGCGCATTAGCGCG |
| 110 | NLpep55 (w/ Met) | A.A. | MGVTGWRLSKRISA |
| 111 | NLpep56 (w/ Met) | N.A. | ATGGGAGTGACCGGCTGGCGGCTGGGCAAGCGCATTAGCGCG |
| 112 | NLpep56 (w/ Met) | A.A. | MGVTGWRLHKRISA |
| 113 | NLpep57 (w/ Met) | N.A. | ATGGGAGTGACCGGCTGGCGGCTGATGAAGCGCATTAGCGCG |
| 114 | NLpep57 (w/ Met) | A.A. | MGVTGWRLMKRISA |
| 115 | NLpep58 (w/ Met) | N.A. | ATGGGAGTGACCGGCTGGCGGCTGGCCAAGCGCATTAGCGCG |
| 116 | NLpep58 (w/ Met) | A.A. | MGVTGWRLAKRISA |
| 117 | NLpep59 (w/ Met) | N.A. | ATGGGAGTGACCGGCTGGCGGCTGCAGAAGCGCATTAGCGCG |
| 118 | NLpep59 (w/ Met) | A.A. | MGVTGWRLQKRISA |
| 119 | NLpep60 (w/ Met) | N.A. | ATGGGAGTGACCGGCTGGCGGCTGCTGAAGCGCATTAGCGCG |
| 120 | NLpep60 (w/ Met) | A.A. | MGVTGWRLLKRISA |
| 121 | NLpep61 (w/ Met) | N.A. | ATGGGAGTGACCGGCTGGCGGCTGAAGAAGCGCATTAGCGCG |

TABLE 1-continued

Peptide sequences

| SEQ ID NO. | PEPTIDE NO. | POLYMER | SEQUENCE |
|---|---|---|---|
| 122 | NLpep61 (w/ Met) | A.A. | MGVTGWRLKKRISA |
| 123 | NLpep62 (w/ Met) | N.A. | ATGAACCACACCGGCTGGCGGCTGAACAAGAAGGTGAGCAAC |
| 124 | NLpep62 (w/ Met) | A.A. | MNITGWRLNKKVSN |
| 125 | NLpep63 (w/ Met) | N.A. | ATGAACCACACCGGCTACCGGCTGAACAAGAAGGTGAGCAAC |
| 126 | NLpep63 (w/ Met) | A.A. | MNITGYRLNKKVSN |
| 127 | NLpep64 (w/ Met) | N.A. | ATGTGCGTGACCGGCTGGCGGCTGTTCAAGCGCATTAGCGCG |
| 128 | NLpep64 (w/ Met) | A.A. | MCVTGWRLFKRISA |
| 129 | NLpep65 (w/ Met) | N.A. | ATGCCCGTGACCGGCTGGCGGCTGTTCAAGCGCATTAGCGCG |
| 130 | NLpep65 (w/ Met) | A.A. | MPVTGWRLFKRISA |
| 131 | NLpep66 (w/ Met) | N.A. | ATGAACCACACCGGCTACCGGCTGTTCAAGAAGGTGAGCAAC |
| 132 | NLpep66 (w/ Met) | A.A. | MNITGYRLFKKVSN |
| 133 | NLpep67 (w/ Met) | N.A. | ATGAACGTGACCGGCTACCGGCTGTTCAAGAAGGTGAGCAAC |
| 134 | NLpep67 (w/ Met) | A.A. | MNVTGYRLFKKVSN |
| 135 | NLpep68 (w/ Met) | N.A. | ATGAACGTGACCGGCTGGCGGCTGTTCAAGAAGGTGAGCAAC |
| 136 | NLpep68 (w/ Met) | A.A. | MNVTGWRLFKKVSN |
| 137 | NLpep69 (w/ Met) | N.A. | ATGAACGTGACCGGCTGGCGGCTGTTCAAGAAGATTAGCAAC |
| 138 | NLpep69 (w/ Met) | A.A. | MNVTGWRLFKKISN |
| 139 | NLpep70 (w/ Met) | N.A. | ATGAACGTGACCGGCTGGCGGCTGTTCAAGCGCATTAGCAAC |
| 140 | NLpep70 (w/ Met) | A.A. | MNVTGWRLFKRISN |
| 141 | NLpep71 (w/ Met) | N.A. | ATGGGAGTGACCGGCTGGCGGCTGTTCAAGCGCATTAGCAAC |
| 142 | NLpep71 (w/ Met) | A.A. | MGVTGWRLFKRISN |
| 143 | NLpep72 (w/ Met) | N.A. | ATGAACGTGACCGGCTGGCGGCTGTTCGAACGCATTAGCAAC |
| 144 | NLpep72 (w/ Met) | A.A. | MNVTGWRLFERISN |
| 145 | NLpep73 (w/ Met) | N.A. | ATGAACGTGACCGGCTGGCGGCTGTTCAAGCGCATTCTGAAC |
| 146 | NLpep73 (w/ Met) | A.A. | MNVTGWRLFKRILN |
| 147 | NLpep74 (w/ Met) | N.A. | ATGAACGTGACCGGCTGGCGGCTGTTCAAGCGCATTAGCGCG |
| 148 | NLpep74 (w/ Met) | A.A. | MNVTGWRLFKRISA |
| 149 | NLpep75 (w/ Met) | N.A. | ATGAACGTGACCGGCTGGCGGCTGTTCGAAAAGATTAGCAAC |
| 150 | NLpep75 (w/ Met) | A.A. | MNVTGWRLFEKISN |
| 151 | NLpep76 (w/ Met) | N.A. | ATGAACGTGAGCGGCTGGCGGCTGTTCGAAAAGATTAGCAAC |

TABLE 1-continued

Peptide sequences

| SEQ ID NO. | PEPTIDE NO. | POLYMER | SEQUENCE |
|---|---|---|---|
| 152 | NLpep76 (w/ Met) | A.A. | MNVSGWRLFEKISN |
| 153 | NLpep77 (w/ Met) | N.A. | ATG-GTGACCGGCTGGCGGCTGTTCAAGAAGATTAGCAAC |
| 154 | NLpep77 (w/ Met) | A.A. | M-VTGWRLFKKISN |
| 155 | NLpep78 (w/ Met) | N.A. | ATGAACGTGAGCGGCTGGCGGCTGTTCAAGAAGATTAGCAAC |
| 156 | NLpep78 (w/ Met) | A.A. | MNVSGWRLFKKISN |
| 157 | NLpep79 (w/ Met) | N.A. | ATGAACGTGACCGGCTACCGGCTGTTCAAGAAGATTAGCAAC |
| 158 | NLpep79 (w/ Met) | A.A. | MNVTGYRLFKKISN |
| 159 | NLpep80 (w/ Met) | N.A. | ATGGTGAGCGGCTGGCGGCTGTTCAAGAAGATTAGCAAC |
| 160 | NLpep80 (w/ Met) | A.A. | MVSGWRLFKKISN |
| 161 | NLpep81 (w/ Met) | N.A. | ATGAGCGGCTGGCGGCTGTTCAAGAAGATTAGCAAC |
| 440 | NLpep81 (w/ Met) | A.A. | MSGWRLFKKISN |
| 163 | NLpep82 (w/ Met) | N.A. | ATGGGCTGGCGGCTGTTCAAGAAGATTAGCAAC |
| 164 | NLpep82 (w/ Met) | A.A. | MGWRLFKKISN |
| 165 | NLpep83 (w/ Met) | N.A. | ATGAACGTGAGCGGCTGGCGGCTGTTCAAGAAGATTAGC |
| 166 | NLpep83 (w/ Met) | A.A. | MNVSGWRLFKKIS |
| 167 | NLpep84 (w/ Met) | N.A. | ATGAACGTGAGCGGCTGGCGGCTGTTCAAGAAGATT |
| 168 | NLpep84 (w/ Met) | A.A. | MNVSGWRLFKKI |
| 169 | NLpep85 (w/ Met) | N.A. | ATGAACGTGAGCGGCTGGCGGCTGTTCAAGAAG |
| 170 | NLpep85 (w/ Met) | A.A. | MNVSGWRLFKK |
| 171 | NLpep86 (w/ Met) | N.A. | ATGGTGAGCGGCTGGCGGCTGTTCAAGAAGATTAGC |
| 172 | NLpep86 (w/ Met) | A.A. | MVSGWRLFKKIS |
| 173 | NLpep87 (w/ Met) | N.A. | ATGAGCGGCTGGCGGCTGTTCAAGAAGATT |
| 174 | NLpep87 (w/ Met) | A.A. | MSGWRLFKKI |
| 175 | NLpep88 (w/ Met) | N.A. | ATGAACGTGAGCGGCTGGGGCCTGTTCAAGAAGATTAGCAAC |
| 176 | NLpep88 (w/ Met) | A.A. | MNVSGWGLFKKISN |
| 177 | NLpep89 (w/ Met) | N.A. | ATGCCCGTGAGCGGCTGGCGGCTGTTCAAGAAGATTAGCAAC |
| 178 | NLpep89 (w/ Met) | A.A. | MPVSGWRLFKKISN |
| 179 | NLpep90 (w/ Met) | N.A. | ATGAACCCCGTGAGCGGCTGGCGGCTGTTCAAGAAGATTAGCAAC |
| 180 | NLpep90 (w/ Met) | A.A. | MNPVSGWRLFKKISN |
| 181 | NLpep91 (w/ Met) | N.A. | ATGATCAACCCCGTGAGCGGCTGGCGGCTGTTCAAGAAGATTAGCAAC |
| 182 | NLpep91 (w/ Met) | A.A. | MINPVSGWRLFKKISN |
| 183 | NLpep92 (w/ Met) | N.A. | ATGACCATCAACCCCGTGAGCGGCTGGCGGCTGTTCAAGAAGATTAGCAAC |

TABLE 1-continued

Peptide sequences

| SEQ ID NO. | PEPTIDE NO. | POLYMER | SEQUENCE |
|---|---|---|---|
| 184 | NLpep92 (w/ Met) | A.A. | MTINPVSGWRLFKKISN |
| 185 | NLpep93 (w/ Met) | N.A. | ATGGTGACCATCAACCCCGTGAGCGGCTGGCGGCTGTTCAAGAAGATTAGCAAC |
| 186 | NLpep93 (w/ Met) | A.A. | MVTINPVSGWRLFKKISN |
| 187 | NLpep94 (w/ Met) | N.A. | ATGCGGGTGACCATCAACCCCGTGAGCGGCTGGCGGCTGTTCAAGAAGATTAGCAAC |
| 188 | NLpep94 (w/ Met) | A.A. | MRVTINPVSGWRLFKKISN |
| 189 | NLpep95 (w/ Met) | N.A. | ATGAGCGGCTGGCGGCTGCTGAAGAAGATT |
| 190 | NLpep95 (w/ Met) | A.A. | MSGWRLLKKI |
| 191 | NLpep96 (w/ Met) | N.A. | ATGACCGGCTACCGGCTGCTGAAGAAGATT |
| 192 | NLpep96 (w/ Met) | A.A. | MTGYRLLKKI |
| 193 | NLpep97 (w/ Met) | N.A. | ATGAGCGGCTGGCGGCTGTTCAAGAAG |
| 194 | NLpep97 (w/ Met) | A.A. | MSGWRLFKK |
| 195 | NLpep98 (w/ Met) | N.A. | ATGGTGACCGGCTACCGGCTGTTCAAGAAGATTAGC |
| 196 | NLpep98 (w/ Met) | A.A. | MVTGYRLFKKIS |
| 197 | NLpep99 (w/ Met) | N.A. | ATGGTGACCGGCTACCGGCTGTTCGAGAAGATTAGC |
| 198 | NLpep99 (w/ Met) | A.A. | MVTGYRLFEKIS |
| 199 | NLpep100 (w/ Met) | N.A. | ATGGTGACCGGCTACCGGCTGTTCGAGCAGATTAGC |
| 200 | NLpep100 (w/ Met) | A.A. | MVTGYRLFEQIS |
| 201 | NLpep101 (w/ Met) | N.A. | ATGGTGACCGGCTACCGGCTGTTCGAGAAGGAGAGC |
| 202 | NLpep101 (w/ Met) | A.A. | MVTGYRLFEKES |
| 203 | NLpep102 (w/ Met) | N.A. | ATGGTGACCGGCTACCGGCTGTTCGAGCAGGAGAGC |
| 204 | NLpep102 (w/ Met) | A.A. | MVTGYRLFEQES |
| 205 | NLpep103 (w/ Met) | N.A. | ATGGTGACCGGCTACCGGCTGTTCGAGCAGGAGCTG |
| 206 | NLpep103 (w/ Met) | A.A. | MVTGYRLFEQEL |
| 207 | NLpep104 (w/ Met) | N.A. | ATGGTGGAGGGCTACCGGCTGTTCGAGAAGATTAGC |
| 208 | NLpep104 (w/ Met) | A.A. | MVEGYRLFEKIS |
| 209 | NLpep105 (w/ Met) | N.A. | ATGGTGGAGGGCTACCGGCTGTTCGAGCAGATTAGC |
| 210 | NLpep105 (w/ Met) | A.A. | MVEGYRLFEQIS |
| 211 | NLpep106 (w/ Met) | N.A. | ATGGTGGAGGGCTACCGGCTGTTCGAGAAGGAGAGC |
| 212 | NLpep106 (w/ Met) | A.A. | MVEGYRLFEKES |
| 213 | NLpep107 (w/ Met) | N.A. | ATGGTGGAGGGCTACCGGCTGTTCGAGCAGGAGAGC |
| 214 | NLpep107 (w/ Met) | A.A. | MVEGYRLFEQES |
| 215 | NLpep108 (w/ Met) | N.A. | ATGGTGGAGGGCTACCGGCTGTTCGAGCAGGAGCTG |
| 216 | NLpep108 (w/ Met) | A.A. | MVEGYRLFEQEL |
| 217 | NLpep109 (w/ Met) | N.A. | ATGATTAGCGGCTGGCGGCTGATGAAGAACATTAGC |
| 218 | NLpep109 (w/ Met) | A.A. | MISGWRLMKNIS |
| 219 | NLpep110 (w/ Met) | N.A. | ATGGTGGAGGGCTACCGGCTGTTCAAGAAGATTAGC |

TABLE 1-continued

Peptide sequences

| SEQ ID NO. | PEPTIDE NO. | POLYMER | SEQUENCE |
|---|---|---|---|
| 220 | NLpep110 (w/ Met) | A.A. | MVEGYRLFKKIS |
| 221 | NLpep2 (w/o Met) | N.A. | GACGTGACCGGCTGGCGGCTGTGCGAACGCATTCTGGCG |
| 222 | NLpep2 (w/o Met) | A.A. | DVTGWRLCERILA |
| 223 | NLpep3 (w/o Met) | N.A. | GGAGTGACCGCCTGGCGGCTGTGCGAACGCATTCTGGCG |
| 224 | NLpep3 (w/o Met) | A.A. | GVTAWRLCERILA |
| 225 | NLpep4 (w/o Met) | N.A. | GGAGTGACCGGCTGGCGGCTGTGCAAGCGCATTCTGGCG |
| 226 | NLpep4 (w/o Met) | A.A. | GVTGWRLCKRILA |
| 227 | NLpep5 (w/o Met) | N.A. | GGAGTGACCGGCTGGCGGCTGTGCGAACGCATTAGCGCG |
| 228 | NLpep5 (w/o Met) | A.A. | GVTGWRLCERISA |
| 229 | NLpep6 (w/o Met) | N.A. | GACGTGACCGGCTGGCGGCTGTGCAAGCGCATTAGCGCG |
| 230 | NLpep6 (w/o Met) | A.A. | DVTGWRLCKRISA |
| 231 | NLpep7 (w/o Met) | N.A. | GACGTGACCGGCTGGCGGCTGTGCAAGCGCATTCTGGCG |
| 232 | NLpep7 (w/o Met) | A.A. | DVTGWRLCKRILA |
| 233 | NLpep8 (w/o Met) | N.A. | GACGTGACCGGCTGGCGGCTGTGCGAACGCATTAGCGCG |
| 234 | NLpep8 (w/o Met) | A.A. | DVTGWRLCERISA |
| 235 | NLpep9 (w/o Met) | N.A. | GGAGTGACCGGCTGGCGGCTGTGCAAGCGCATTAGCGCG |
| 236 | NLpep9 (w/o Met) | A.A. | GVTGWRLCKRISA |
| 237 | NLpep10 (w/o Met) | N.A. | GGAGTGACCGGCTGGCGGCTGAACGAACGCATTCTGGCG |
| 238 | NLpep10 (w/o Met) | A.A. | GVTGWRLNERILA |
| 239 | NLpep11 (w/o Met) | N.A. | GGAGTGACCGGCTGGCGGCTGCAGGAACGCATTCTGGCG |
| 240 | NLpep11 (w/o Met) | A.A. | GVTGWRLQERILA |
| 241 | NLpep12 (w/o Met) | N.A. | GGAGTGACCGGCTGGCGGCTGAAGAAGCGCCGGAGCGG |
| 242 | NLpep12 (w/o Met) | A.A. | GVTGWRLKKRRSR |
| 243 | NLpep13 (w/o Met) | N.A. | AACGTGACCGGCTGGCGGCTGTGCAAGCGCATTAGCGCG |
| 244 | NLpep13 (w/o Met) | A.A. | NVTGWRLCKRISA |
| 245 | NLpep14 (w/o Met) | N.A. | AGCGTGACCGGCTGGCGGCTGTGCAAGCGCATTAGCGCG |
| 246 | NLpep14 (w/o Met) | A.A. | SVTGWRLCKRISA |
| 247 | NLpep15 (w/o Met) | N.A. | GAGGTGACCGGCTGGCGGCTGTGCAAGCGCATTAGCGCG |
| 248 | NLpep15 (w/o Met) | A.A. | EVTGWRLCKRISA |
| 249 | NLpep16 (w/o Met) | N.A. | GGCGTGACCGGCTGGCGGCTGTGCAAGCGCATTAGCGCG |

TABLE 1-continued

Peptide sequences

| SEQ ID NO. | PEPTIDE NO. | POLYMER | SEQUENCE |
|---|---|---|---|
| 250 | NLpep16 (w/o Met) | A.A. | HVTGWRLCKRISA |
| 251 | NLpep17 (w/o Met) | N.A. | GGACACACCGGCTGGCGGCTGTGCAAGCGCATTAGCGCG |
| 252 | NLpep17 (w/o Met) | A.A. | GITGWRLCKRISA |
| 253 | NLpep18 (w/o Met) | N.A. | GGAGCCACCGGCTGGCGGCTGTGCAAGCGCATTAGCGCG |
| 254 | NLpep18 (w/o Met) | A.A. | GATGWRLCKRISA |
| 255 | NLpep19 (w/o Met) | N.A. | GGAAAGACCGGCTGGCGGCTGTGCAAGCGCATTAGCGCG |
| 256 | NLpep19 (w/o Met) | A.A. | GKTGWRLCKRISA |
| 257 | NLpep20 (w/o Met) | N.A. | GGACAGACCGGCTGGCGGCTGTGCAAGCGCATTAGCGCG |
| 258 | NLpep20 (w/o Met) | A.A. | GQTGWRLCKRISA |
| 259 | NLpep21 (w/o Met) | N.A. | GGAAGCACCGGCTGGCGGCTGTGCAAGCGCATTAGCGCG |
| 260 | NLpep21 (w/o Met) | A.A. | GSTGWRLCKRISA |
| 261 | NLpep22 (w/o Met) | N.A. | GGAGTGGTGGGCTGGCGGCTGTGCAAGCGCATTAGCGCG |
| 262 | NLpep22 (w/o Met) | A.A. | GVVGWRLCKRISA |
| 263 | NLpep23 (w/o Met) | N.A. | GGAGTGAAGGGCTGGCGGCTGTGCAAGCGCATTAGCGCG |
| 264 | NLpep23 (w/o Met) | A.A. | GVKGWRLCKRISA |
| 265 | NLpep24 (w/o Met) | N.A. | GGAGTGCAGGGCTGGCGGCTGTGCAAGCGCATTAGCGCG |
| 266 | NLpep24 (w/o Met) | A.A. | GVQGWRLCKRISA |
| 267 | NLpep25 (w/o Met) | N.A. | GGAGTGACCGGCACCCGGCTGTGCAAGCGCATTAGCGCG |
| 268 | NLpep25 (w/o Met) | A.A. | GVTGTRLCKRISA |
| 269 | NLpep26 (w/o Met) | N.A. | GGAGTGACCGGCAAGCGGCTGTGCAAGCGCATTAGCGCG |
| 270 | NLpep26 (w/o Met) | A.A. | GVTGKRLCKRISA |
| 271 | NLpep27 (w/o Met) | N.A. | GGAGTGACCGGCGTGCGGCTGTGCAAGCGCATTAGCGCG |
| 272 | NLpep27 (w/o Met) | A.A. | GVTGVRLCKRISA |
| 273 | NLpep28 (w/o Met) | N.A. | GGAGTGACCGGCTGGCGGCACTGCAAGCGCATTAGCGCG |
| 274 | NLpep28 (w/o Met) | A.A. | GVTGWRICKRISA |
| 275 | NLpep29 (w/o Met) | N.A. | GGAGTGACCGGCTGGCGGGTGTGCAAGCGCATTAGCGCG |
| 276 | NLpep29 (w/o Met) | A.A. | GVTGWRVCKRISA |
| 277 | NLpep30 (w/o Met) | N.A. | GGAGTGACCGGCTGGCGGACCTGCAAGCGCATTAGCGCG |
| 278 | NLpep30 (w/o Met) | A.A. | GVTGWRTCKRISA |
| 279 | NLpep31 (w/o Met) | N.A. | GGAGTGACCGGCTGGCGGTACTGCAAGCGCATTAGCGCG |

TABLE 1-continued

Peptide sequences

| SEQ ID NO. | PEPTIDE NO. | POLYMER | SEQUENCE |
| --- | --- | --- | --- |
| 280 | NLpep31 (w/o Met) | A.A. | GVTGWRYCKRISA |
| 281 | NLpep32 (w/o Met) | N.A. | GGAGTGACCGGCTGGCGGAAGTGCAAGCGCATTAGCGCG |
| 282 | NLpep32 (w/o Met) | A.A. | GVTGWRKCKRISA |
| 283 | NLpep33 (w/o Met) | N.A. | GGAGTGACCGGCTGGCGGCTGAACAAGCGCATTAGCGCG |
| 284 | NLpep33 (w/o Met) | A.A. | GVTGWRLNKRISA |
| 285 | NLpep34 (w/o Met) | N.A. | GGAGTGACCGGCTGGCGGCTGACCAAGCGCATTAGCGCG |
| 286 | NLpep34 (w/o Met) | A.A. | GVTGWRLTKRISA |
| 287 | NLpep35 (w/o Met) | N.A. | GGAGTGACCGGCTGGCGGCTGTGCAAGAAGATTAGCGCG |
| 288 | NLpep35 (w/o Met) | A.A. | GVTGWRLCKKISA |
| 289 | NLpep36 (w/o Met) | N.A. | GGAGTGACCGGCTGGCGGCTGTGCAAGAACATTAGCGCG |
| 290 | NLpep36 (w/o Met) | A.A. | GVTGWRLCKNISA |
| 291 | NLpep37 (w/o Met) | N.A. | GGAGTGACCGGCTGGCGGCTGTGCAAGCGCGTGAGCGCG |
| 292 | NLpep37 (w/o Met) | A.A. | GVTGWRLCKRVSA |
| 293 | NLpep38 (w/o Met) | N.A. | GGAGTGACCGGCTGGCGGCTGTGCAAGCGCCAGAGCGCG |
| 294 | NLpep38 (w/o Met) | A.A. | GVTGWRLCKRQSA |
| 295 | NLpep39 (w/o Met) | N.A. | GGAGTGACCGGCTGGCGGCTGTGCAAGCGCGAGAGCGCG |
| 296 | NLpep39 (w/o Met) | A.A. | GVTGWRLCKRESA |
| 297 | NLpep40 (w/o Met) | N.A. | GGAGTGACCGGCTGGCGGCTGTGCAAGCGCCGGAGCGCG |
| 298 | NLpep40 (w/o Met) | A.A. | GVTGWRLCKRRSA |
| 299 | NLpep41 (w/o Met) | N.A. | GGAGTGACCGGCTGGCGGCTGTGCAAGCGCTTCAGCGCG |
| 300 | NLpep41 (w/o Met) | A.A. | GVTGWRLCKRFSA |
| 301 | NLpep42 (w/o Met) | N.A. | GGAGTGACCGGCTGGCGGCTGTGCAAGCGCATTAGCAAC |
| 302 | NLpep42 (w/o Met) | A.A. | GVTGWRLCKRISN |
| 303 | NLpep43 (w/o Met) | N.A. | GGAGTGACCGGCTGGCGGCTGTGCAAGCGCATTAGCACC |
| 304 | NLpep43 (w/o Met) | A.A. | GVTGWRLCKRIST |
| 305 | NLpep44 (w/o Met) | N.A. | GGAGTGACCGGCTGGCGGCTGTGCAAGCGCATTAGCCGG |
| 306 | NLpep44 (w/o Met) | A.A. | GVTGWRLCKRISR |
| 307 | NLpep45 (w/o Met) | N.A. | GGAGTGACCGGCTGGCGGCTGTGCAAGCGCATTAGCCTG |
| 308 | NLpep45 (w/o Met) | A.A. | GVTGWRLCKRISL |
| 309 | NLpep46 (w/o Met) | N.A. | GGAGTGACCGGCTGGCGGCTGTGCAAGCGCATTAGCGAG |

TABLE 1-continued

Peptide sequences

| SEQ ID NO. | PEPTIDE NO. | POLYMER | SEQUENCE |
|---|---|---|---|
| 310 | NLpep46 (w/o Met) | A.A. | GVTGWRLCKRISE |
| 311 | NLpep47 (w/o Met) | N.A. | GGAGTGACCGGCTTCCGGCTGTGCAAGCGCATTAGCGCG |
| 312 | NLpep47 (w/o Met) | A.A. | GVTGFRLCKRISA |
| 313 | NLpep48 (w/o Met) | N.A. | GGAGTGACCGGCTACCGGCTGTGCAAGCGCATTAGCGCG |
| 314 | NLpep48 (w/o Met) | A.A. | GVTGYRLCKRISA |
| 315 | NLpep49 (w/o Met) | N.A. | GGAGTGACCGGCGAGCGGCTGTGCAAGCGCATTAGCGCG |
| 316 | NLpep49 (w/o Met) | A.A. | GVTGERLCKRISA |
| 317 | NLpep50 (w/o Met) | N.A. | CAGGTGACCGGCTGGCGGCTGTGCAAGCGCATTAGCGCG |
| 318 | NLpep50 (w/o Met) | A.A. | QVTGWRLCKRISA |
| 319 | NLpep51 (w/o Met) | N.A. | ACCGTGACCGGCTGGCGGCTGTGCAAGCGCATTAGCGCG |
| 320 | NLpep51 (w/o Met) | A.A. | TVTGWRLCKRISA |
| 321 | NLpep52 (w/o Met) | N.A. | GGAGTGGAGGGCTGGCGGCTGTGCAAGCGCATTAGCGCG |
| 322 | NLpep52 (w/o Met) | A.A. | GVEGWRLCKRISA |
| 323 | NLpep53 (w/o Met) | N.A. | GGAGTGACCGGCTGGCGGCTGTTCAAGCGCATTAGCGCG |
| 324 | NLpep53 (w/o Met) | A.A. | GVTGWRLFKRISA |
| 325 | NLpep54 (w/o Met) | N.A. | GGAGTGACCGGCTGGCGGCTGTACAAGCGCATTAGCGCG |
| 326 | NLpep54 (w/o Met) | A.A. | GVTGWRLYKRISA |
| 327 | NLpep55 (w/o Met) | N.A. | GGAGTGACCGGCTGGCGGCTGAGCAAGCGCATTAGCGCG |
| 328 | NLpep55 (w/o Met) | A.A. | GVTGWRLSKRISA |
| 329 | NLpep56 (w/o Met) | N.A. | GGAGTGACCGGCTGGCGGCTGGGCAAGCGCATTAGCGCG |
| 330 | NLpep56 (w/o Met) | A.A. | GVTGWRLHKRISA |
| 331 | NLpep57 (w/o Met) | N.A. | GGAGTGACCGGCTGGCGGCTGATGAAGCGCATTAGCGCG |
| 332 | NLpep57 (w/o Met) | A.A. | GVTGWRLMKRISA |
| 333 | NLpep58 (w/o Met) | N.A. | GGAGTGACCGGCTGGCGGCTGGCCAAGCGCATTAGCGCG |
| 334 | NLpep58 (w/o Met) | A.A. | GVTGWRLAKRISA |
| 335 | NLpep59 (w/o Met) | N.A. | GGAGTGACCGGCTGGCGGCTGCAGAAGCGCATTAGCGCG |
| 336 | NLpep59 (w/o Met) | A.A. | GVTGWRLQKRISA |
| 337 | NLpep60 (w/o Met) | N.A. | GGAGTGACCGGCTGGCGGCTGCTGAAGCGCATTAGCGCG |
| 338 | NLpep60 (w/o Met) | A.A. | GVTGWRLLKRISA |
| 339 | NLpep61 (w/o Met) | N.A. | GGAGTGACCGGCTGGCGGCTGAAGAAGCGCATTAGCGCG |

TABLE 1-continued

Peptide sequences

| SEQ ID NO. | PEPTIDE NO. | POLYMER | SEQUENCE |
|---|---|---|---|
| 340 | NLpep61 (w/o Met) | A.A. | GVTGWRLKKRISA |
| 341 | NLpep62 (w/o Met) | N.A. | AACCACACCGGCTGGCGGCTGAACAAGAAGGTGAGCAAC |
| 342 | NLpep62 (w/o Met) | A.A. | NITGWRLNKKVSN |
| 343 | NLpep63 (w/o Met) | N.A. | AACCACACCGGCTACCGGCTGAACAAGAAGGTGAGCAAC |
| 344 | NLpep63 (w/o Met) | A.A. | NITGYRLNKKVSN |
| 345 | NLpep64 (w/o Met) | N.A. | TGCGTGACCGGCTGGCGGCTGTTCAAGCGCATTAGCGCG |
| 346 | NLpep64 (w/o Met) | A.A. | CVTGWRLFKRISA |
| 347 | NLpep65 (w/o Met) | N.A. | CCCGTGACCGGCTGGCGGCTGTTCAAGCGCATTAGCGCG |
| 348 | NLpep65 (w/o Met) | A.A. | PVTGWRLFKRISA |
| 349 | NLpep66 (w/o Met) | N.A. | AACCACACCGGCTACCGGCTGTTCAAGAAGGTGAGCAAC |
| 350 | NLpep66 (w/o Met) | A.A. | NITGYRLFKKVSN |
| 351 | NLpep67 (w/o Met) | N.A. | AACGTGACCGGCTACCGGCTGTTCAAGAAGGTGAGCAAC |
| 352 | NLpep67 (w/o Met) | A.A. | NVTGYRLFKKVSN |
| 353 | NLpep68 (w/o Met) | N.A. | AACGTGACCGGCTGGCGGCTGTTCAAGAAGGTGAGCAAC |
| 354 | NLpep68 (w/o Met) | A.A. | NVTGWRLFKKVSN |
| 355 | NLpep69 (w/o Met) | N.A. | AACGTGACCGGCTGGCGGCTGTTCAAGAAGATTAGCAAC |
| 356 | NLpep69 (w/o Met) | A.A. | NVTGWRLFKKISN |
| 357 | NLpep70 (w/o Met) | N.A. | AACGTGACCGGCTGGCGGCTGTTCAAGCGCATTAGCAAC |
| 358 | NLpep70 (w/o Met) | A.A. | NVTGWRLFKRISN |
| 359 | NLpep71 (w/o Met) | N.A. | GGAGTGACCGGCTGGCGGCTGTTCAAGCGCATTAGCAAC |
| 360 | NLpep71 (w/o Met) | A.A. | GVTGWRLFKRISN |
| 361 | NLpep72 (w/o Met) | N.A. | AACGTGACCGGCTGGCGGCTGTTCGAACGCATTAGCAAC |
| 362 | NLpep72 (w/o Met) | A.A. | NVTGWRLFERISN |
| 363 | NLpep73 (w/o Met) | N.A. | AACGTGACCGGCTGGCGGCTGTTCAAGCGCATTCTGAAC |
| 364 | NLpep73 (w/o Met) | A.A. | NVTGWRLFKRILN |
| 365 | NLpep74 (w/o Met) | N.A. | AACGTGACCGGCTGGCGGCTGTTCAAGCGCATTAGCGCG |
| 366 | NLpep74 (w/o Met) | A.A. | NVTGWRLFKRISA |
| 367 | NLpep75 (w/o Met) | N.A. | AACGTGACCGGCTGGCGGCTGTTCGAAAAGATTAGCAAC |
| 368 | NLpep75 (w/o Met) | A.A. | NVTGWRLFEKISN |
| 369 | NLpep76 (w/o Met) | N.A. | AACGTGAGCGGCTGGCGGCTGTTCGAAAAGATTAGCAAC |

TABLE 1-continued

Peptide sequences

| SEQ ID NO. | PEPTIDE NO. | POLYMER | SEQUENCE |
|---|---|---|---|
| 370 | NLpep76 (w/o Met) | A.A. | NVSGWRLFEKISN |
| 371 | NLpep77 (w/o Met) | N.A. | GTGACCGGCTGGCGGCTGTTCAAGAAGATTAGCAAC |
| 372 | NLpep77 (w/o Met) | A.A. | VTGWRLFKKISN |
| 373 | NLpep78 (w/o Met) | N.A. | AACGTGAGCGGCTGGCGGCTGTTCAAGAAGATTAGCAAC |
| 374 | NLpep78 (w/o Met) | A.A. | NVSGWRLFKKISN |
| 375 | NLpep79 (w/o Met) | N.A. | AACGTGACCGGCTACCGGCTGTTCAAGAAGATTAGCAAC |
| 376 | NLpep79 (w/o Met) | A.A. | NVTGYRLFKKISN |
| 377 | NLpep80 (w/o Met) | N.A. | GTGAGCGGCTGGCGGCTGTTCAAGAAGATTAGCAAC |
| 378 | NLpep80 (w/o Met) | A.A. | VSGWRLFKKISN |
| 379 | NLpep81 (w/o Met) | N.A. | AGCGGCTGGCGGCTGTTCAAGAAGATTAGCAAC |
| 380 | NLpep81 (w/o Met) | A.A. | SGWRLFKKISN |
| 381 | NLpep82 (w/o Met) | N.A. | GGCTGGCGGCTGTTCAAGAAGATTAGCAAC |
| 382 | NLpep82 (w/o Met) | A.A. | GWRLFKKISN |
| 383 | NLpep83 (w/o Met) | N.A. | AACGTGAGCGGCTGGCGGCTGTTCAAGAAGATTAGC |
| 384 | NLpep83 (w/o Met) | A.A. | NVSGWRLFKKIS |
| 385 | NLpep84 (w/o Met) | N.A. | AACGTGAGCGGCTGGCGGCTGTTCAAGAAGATT |
| 386 | NLpep84 (w/o Met) | A.A. | NVSGWRLFKKI |
| 387 | NLpep85 (w/o Met) | N.A. | AACGTGAGCGGCTGGCGGCTGTTCAAGAAG |
| 388 | NLpep85 (w/o Met) | A.A. | NVSGWRLFKK |
| 389 | NLpep86 (w/o Met) | N.A. | GTGAGCGGCTGGCGGCTGTTCAAGAAGATTAGC |
| 390 | NLpep86 (w/o Met) | A.A. | VSGWRLFKKIS |
| 391 | NLpep87 (w/o Met) | N.A. | AGCGGCTGGCGGCTGTTCAAGAAGATT |
| 392 | NLpep87 (w/o Met) | A.A. | SGWRLFKKI |
| 393 | NLpep88 (w/o Met) | N.A. | AACGTGAGCGGCTGGGGCCTGTTCAAGAAGATTAGCAAC |
| 394 | NLpep88 (w/o Met) | A.A. | NVSGWGLFKKISN |
| 395 | NLpep89 (w/o Met) | N.A. | CCCGTGAGCGGCTGGCGGCTGTTCAAGAAGATTAGCAAC |
| 396 | NLpep89 (w/o Met) | A.A. | PVSGWRLFKKISN |
| 397 | NLpep90 (w/o Met) | N.A. | AACCCCGTGAGCGGCTGGCGGCTGTTCAAGAAGATTAGCAAC |
| 398 | NLpep90 (w/o Met) | A.A. | NPVSGWRLFKKISN |
| 399 | NLpep91 (w/o Met) | N.A. | ATCAACCCCGTGAGCGGCTGGCGGCTGTTCAAGAAGATTAGCAAC |
| 400 | NLpep91 (w/o Met) | A.A. | INPVSGWRLFKKISN |
| 401 | NLpep92 (w/o Met) | N.A. | ACCATCAACCCCGTGAGCGGCTGGCGGCTGTTCAAGAAGATTAGCAAC |
| 402 | NLpep92 (w/o Met) | A.A. | TINPVSGWRLFKKISN |

TABLE 1-continued

Peptide sequences

| SEQ ID NO. | PEPTIDE NO. | POLYMER | SEQUENCE |
|---|---|---|---|
| 403 | NLpep93 (w/o Met) | N.A. | GTGACCATCAACCCCGTGAGCGGCTGGCGGCTGTTCAAGAAGATTAGCAAC |
| 404 | NLpep93 (w/o Met) | A.A. | VTINPVSGWRLFKKISN |
| 405 | NLpep94 (w/o Met) | N.A. | CGGGTGACCATCAACCCCGTGAGCGGCTGGCGGCTGTTCAAGAAGATTAGCAAC |
| 406 | NLpep94 (w/o Met) | A.A. | RVTINPVSGWRLFKKISN |
| 407 | NLpep95 (w/o Met) | N.A. | AGCGGCTGGCGGCTGCTGAAGAAGATT |
| 408 | NLpep95 (w/o Met) | A.A. | SGWRLLKKI |
| 409 | NLpep96 (w/o Met) | N.A. | ACCGGCTACCGGCTGCTGAAGAAGATT |
| 410 | NLpep96 (w/o Met) | A.A. | TGYRLLKKI |
| 411 | NLpep97 (w/o Met) | N.A. | AGCGGCTGGCGGCTGTTCAAGAAG |
| 412 | NLpep97 (w/o Met) | A.A. | SGWRLFKK |
| 413 | NLpep98 (w/o Met) | N.A. | GTGACCGGCTACCGGCTGTTCAAGAAGATTAGC |
| 414 | NLpep98 (w/o Met) | A.A. | VTGYRLFKKIS |
| 415 | NLpep99 (w/o Met) | N.A. | GTGACCGGCTACCGGCTGTTCGAGAAGATTAGC |
| 416 | NLpep99 (w/o Met) | A.A. | VTGYRLFEKIS |
| 417 | NLpep100 (w/o Met) | N.A. | GTGACCGGCTACCGGCTGTTCGAGCAGATTAGC |
| 418 | NLpep100 (w/o Met) | A.A. | VTGYRLFEQIS |
| 419 | NLpep101 (w/o Met) | N.A. | GTGACCGGCTACCGGCTGTTCGAGAAGGAGAGC |
| 420 | NLpep101 (w/o Met) | A.A. | VTGYRLFEKES |
| 421 | NLpep102 (w/o Met) | N.A. | GTGACCGGCTACCGGCTGTTCGAGCAGGAGAGC |
| 422 | NLpep102 (w/o Met) | A.A. | VTGYRLFEQES |
| 423 | NLpep103 (w/o Met) | N.A. | GTGACCGGCTACCGGCTGTTCGAGCAGGAGCTG |
| 424 | NLpep103 (w/o Met) | A.A. | VTGYRLFEQEL |
| 425 | NLpep104 (w/o Met) | N.A. | GTGGAGGGCTACCGGCTGTTCGAGAAGATTAGC |
| 426 | NLpep104 (w/o Met) | A.A. | VEGYRLFEKIS |
| 427 | NLpep105 (w/o Met) | N.A. | GTGGAGGGCTACCGGCTGTTCGAGCAGATTAGC |
| 428 | NLpep105 (w/o Met) | A.A. | VEGYRLFEQIS |
| 429 | NLpep106 (w/o Met) | N.A. | GTGGAGGGCTACCGGCTGTTCGAGAAGGAGAGC |
| 430 | NLpep106 (w/o Met) | A.A. | VEGYRLFEKES |
| 431 | NLpep107 (w/o Met) | N.A. | GTGGAGGGCTACCGGCTGTTCGAGCAGGAGAGC |
| 432 | NLpep107 (w/o Met) | A.A. | VEGYRLFEQES |
| 433 | NLpep108 (w/o Met) | N.A. | GTGGAGGGCTACCGGCTGTTCGAGCAGGAGCTG |
| 434 | NLpep108 (w/o Met) | A.A. | VEGYRLFEQEL |
| 435 | NLpep109 (w/o Met) | N.A. | ATTAGCGGCTGGCGGCTGATGAAGAACATTAGC |
| 436 | NLpep109 (w/o Met) | A.A. | ISGWRLMKNIS |
| 437 | NLpep110 (w/o Met) | N.A. | GTGGAGGGCTACCGGCTGTTCAAGAAGATTAGC |
| 438 | NLpep110 (w/o Met) | A.A. | VEGYRLFKKIS |

TABLE 1-continued

Peptide sequences

| SEQ ID NO. | PEPTIDE NO. | POLYMER | SEQUENCE |
|---|---|---|---|
| 2162 | NLpep111 (w/ Met) | N.A. | ATGGTGACCGGCTACCGGCTGTTCGAGGAGATCAGC |
| 2163 | NLpep111 (w/ Met) | A.A. | MVTGYRLFEEIS |
| 2164 | NLpep112 (w/ Met) | N.A. | ATGGTGACCGGCTACCGGCTGTTCGAGGAGGCCAGC |
| 2165 | NLpep112 (w/ Met) | A.A. | MVTGYRLFEEAS |
| 2166 | NLpep113 (w/ Met) | N.A. | ATGGTGACCGGCTACCGGCTGTTCGAGGAGGAGAGC |
| 2167 | NLpep113 (w/ Met) | A.A. | MVTGYRLFEEES |
| 2168 | NLpep114 (w/ Met) | N.A. | ATGGTGACCGGCTACCGGCTGTTCGAGGAGATCCTG |
| 2169 | NLpep114 (w/ Met) | A.A. | MVTGYRLFEEIL |
| 2170 | NLpep115 (w/ Met) | N.A. | ATGGTGACCGGCTACCGGCTGTTCGAGGAGGCCCTG |
| 2171 | NLpep115 (w/ Met) | A.A. | MVTGYRLFEEAL |
| 2172 | NLpep116 (w/ Met) | N.A. | ATGGTGACCGGCTACCGGCTGTTCGAGGAGGAGCTG |
| 2173 | NLpep116 (w/ Met) | A.A. | MVTGYRLFEEEL |
| 2174 | NLpep117 (w/ Met) | N.A. | ATGGTGGAGGGCTACCGGCTGTTCGAGGAGATCAGC |
| 2175 | NLpep117 (w/ Met) | A.A. | MVEGYRLFEEIS |
| 2176 | NLpep118 (w/ Met) | N.A. | ATGGTGGAGGGCTACCGGCTGTTCGAGGAGGCCAGC |
| 2177 | NLpep118 (w/ Met) | A.A. | MVEGYRLFEEAS |
| 2178 | NLpep119 (w/ Met) | N.A. | ATGGTGGAGGGCTACCGGCTGTTCGAGGAGGAGAGC |
| 2179 | NLpep119 (w/ Met) | A.A. | MVEGYRLFEEES |
| 2180 | NLpep120 (w/ Met) | N.A. | ATGGTGGAGGGCTACCGGCTGTTCGAGGAGATCCTG |
| 2181 | NLpep120 (w/ Met) | A.A. | MVEGYRLFEEIL |
| 2182 | NLpep121 (w/ Met) | N.A. | ATGGTGGAGGGCTACCGGCTGTTCGAGGAGGCCCTG |
| 2183 | NLpep121 (w/ Met) | A.A. | MVEGYRLFEEAL |
| 2184 | NLpep122 (w/ Met) | N.A. | ATGGTGGAGGGCTACCGGCTGTTCGAGGAGGAGCTG |
| 2185 | NLpep122 (w/ Met) | A.A. | MVEGYRLFEEEL |
| 2186 | NLpep123 (w/ Met) | N.A. | ATGGTGACCGGCTACCGGCTGTTCAAGAAGATCCTG |
| 2187 | NLpep123 (w/ Met) | A.A. | MVTGYRLFKKIL |
| 2188 | NLpep124 (w/ Met) | N.A. | ATGGTGACCGGCTACCGGCTGATGAAGAAGATCCTG |
| 2189 | NLpep124 (w/ Met) | A.A. | MVTGYRLMKKIL |
| 2190 | NLpep125 (w/ Met) | N.A. | ATGGTGACCGGCTACCGGCTGCACAAGAAGATCCTG |
| 2191 | NLpep125 (w/ Met) | A.A. | MVTGYRLHKKIL |
| 2192 | NLpep126 (w/ Met) | N.A. | ATGGTGACCGGCTACCGGCTGCTGAAGAAGATCCTG |
| 2193 | NLpep126 (w/ Met) | A.A. | MVTGYRLLKKIL |
| 2194 | NLpep127 (w/ Met) | N.A. | ATGGTGACCGGCTACCGGCTGAGCAAGAAGATCCTG |
| 2195 | NLpep127 (w/ Met) | A.A. | MVTGYRLSKKIL |
| 2196 | NLpep128 (w/ Met) | N.A. | ATGGTGACCGGCTACCGGCTGTTCGAGAAGATCCTG |
| 2197 | NLpep128 (w/ Met) | A.A. | MVTGYRLFEKIL |
| 2198 | NLpep129 (w/ Met) | N.A. | ATGGTGACCGGCTACCGGCTGATGGAGAAGATCCTG |

TABLE 1-continued

Peptide sequences

| SEQ ID NO. | PEPTIDE NO. | POLYMER | SEQUENCE |
|---|---|---|---|
| 2199 | NLpep129(w/ Met) | A.A. | MVTGYRLMEKIL |
| 2200 | NLpep130 (w/ Met) | N.A. | ATGGTGACCGGCTACCGGCTGCACGAGAAGATCCTG |
| 2201 | NLpep130 (w/ Met) | A.A. | MVTGYRLHEKIL |
| 2202 | NLpep131 (w/ Met) | N.A. | ATGGTGACCGGCTACCGGCTGCTGGAGAAGATCCTG |
| 2203 | NLpep131 (w/ Met) | A.A. | MVTGYRLLEKIL |
| 2204 | NLpep132 (w/ Met) | N.A. | ATGGTGACCGGCTACCGGCTGAGCGAGAAGATCCTG |
| 2205 | NLpep132 (w/ Met) | A.A. | MVTGYRLSEKIL |
| 2206 | NLpep133 (w/ Met) | N.A. | ATGGTGACCGGCTACCGGCTGATGGAGGAGATCCTG |
| 2207 | NLpep133 (w/ Met) | A.A. | MVTGYRLMEEIL |
| 2208 | NLpep134(w/ Met) | N.A. | ATGGTGACCGGCTACCGGCTGCACGAGGAGATCCTG |
| 2209 | NLpep134(w/ Met) | A.A. | MVTGYRLHEEIL |
| 2210 | NLpep135 (w/ Met) | N.A. | ATGGTGACCGGCTACCGGCTGCTGGAGGAGATCCTG |
| 2211 | NLpep135 (w/ Met) | A.A. | MVTGYRLLEEIL |
| 2212 | NLpep136 (w/ Met) | N.A. | ATGGTGACCGGCTACCGGCTGAGCGAGGAGATCCTG |
| 2213 | NLpep136 (w/ Met) | A.A. | MVTGYRLSEEIL |
| 2214 | NLpep137(w/ Met) | N.A. | ATGGTGAGCGGCTACCGGCTGTTCGAGGAGATCCTG |
| 2215 | NLpep137(w/ Met) | A.A. | MVSGYRLFEEIL |
| 2216 | NLpep138(w/ Met) | N.A. | ATGGTGACCGGCTGGCGGCTGTTCGAGGAGATCCTG |
| 2217 | NLpep138(w/ Met) | A.A. | MVTGWRLFEEIL |
| 2218 | NLpep139 (w/ Met) | N.A. | ATGGTGAGCGGCTGGCGGCTGTTCGAGGAGATCCTG |
| 2219 | NLpep139 (w/ Met) | A.A. | MVSGWRLFEEIL |
| 2220 | NLpep140 (w/ Met) | N.A. | ATGAACGTGACCGGCTACCGGCTGTTCGAGGAGATCCTG |
| 2221 | NLpep140 (w/ Met) | A.A. | MNVTGYRLFEEIL |
| 2222 | NLpep141 (w/ Met) | N.A. | ATGGTGACCGGCTACCGGCTGTTCGAGGAGATCCTGAAC |
| 2223 | NLpep141 (w/ Met) | A.A. | MVTGYRLFEEILN |
| 2224 | NLpep142 (w/ Met) | N.A. | ATGAACGTGACCGGCTACCGGCTGTTCGAGGAGATCCTGAAC |
| 2225 | NLpep142 (w/ Met) | A.A. | MNVTGYRLFEEILN |
| 2226 | NLpep143 (w/ Met) | N.A. | ATGGTGACCGGCTACCGGCTGTTCGAGGAGATC |
| 2227 | NLpep143 (w/ Met) | A.A. | MVTGYRLFEEI |
| 2228 | NLpep144 (w/ Met) | N.A. | ATGGTGACCGGCTACCGGCTGTTCCAGAAGATCAGC |
| 2229 | NLpep144 (w/ Met) | A.A. | MVTGYRLFQKIS |
| 2230 | NLpep145 (w/ Met) | N.A. | ATGGTGACCGGCTACCGGCTGTTCAAGAAGATCAGCAAC |
| 2231 | NLpep145 (w/ Met) | A.A. | MVTGYRLFKKISN |
| 2232 | NLpep146 (w/ Met) | N.A. | ATGGTGACCGGCTACCGGCTGTTCAAGAAGATCAGC |
| 2233 | NLpep146 (w/ Met) | A.A. | MVTGYRLFKKIS |

TABLE 1-continued

Peptide sequences

| SEQ ID NO. | PEPTIDE NO. | POLYMER | SEQUENCE |
|---|---|---|---|
| 2234 | NLpep147 (w/ Met) | A.A. | MVSGWRLFKKISA |
| 2235 | NLpep148 (w/ Met) | A.A. | MGVSGWRLFKKIS |
| 2236 | NLpep149 (w/ Met) | A.A. | MSVSGWRLFKKISN |
| 2237 | NLpep150 (w/ Met) | A.A. | MSVSGWRLFKKISA |
| 2238 | NLpep151 (w/ Met) | A.A. | MNSVSGWRLFKKISA |
| 2239 | NLpep152 (w/ Met) | A.A. | MNSVSGWRLFKKISN |
| 2240 | NLpep153 (w/ Met) | A.A. | MSNVSGWRLFKKIS |
| 2241 | NLpep154 (w/ Met) | A.A. | MSGVSGWRLFKKIS |
| 2242 | NLpep155 (w/ Met) | A.A. | MNSNVSGWRLFKKIS |
| 2243 | NLpep156 (w/ Met) | A.A. | MNSGVSGWRLFKKIS |
| 2244 | NLpep157 (w/ Met) | A.A. | MSVSGWRLFKKIS |
| 2245 | NLpep158 (w/ Met) | A.A. | MNSVSGWRLFKKIS |
| 2246 | NLpep159 (w/ Met) | A.A. | MSNVSGWRLFKKISN |
| 2247 | NLpep160 (w/ Met) | A.A. | MNSNVSGWRLFKKISN |
| 2248 | NLpep161 (w/ Met) | A.A. | MGWRLFKK |
| 2249 | NLpep162 (w/ Met) | A.A. | MGWALFKK |
| 2250 | NLpep163 (w/ Met) | A.A. | MVTGWALFEEIL |
| 2251 | NLpep164 (w/ Met) | A.A. | MVTGYALFQEIL |
| 2252 | NLpep165 (w/ Met) | A.A. | MVTGYALFEQIL |
| 2253 | NLpep166 (w/ Met) | A.A. | MVTGYALFEEIL |
| 2254 | NLpep167 (w/ Met) | N.A. | ATGGTGTCCGGCTGGGCACTGTTCAAGAAAATTTCC |
| 2255 | NLpep167 (w/ Met) | A.A. | MVSGWALFKKIS |
| 2256 | NLpep168 (w/ Met) | A.A. | MVSGWKLFKKIS |
| 2257 | NLpep169 (w/ Met) | N.A. | ATGGTGTCCGGCTGGCAGCTGTTCAAGAAAATTTCC |
| 2258 | NLpep169 (w/ Met) | A.A. | MVSGWQLFKKIS |
| 2259 | NLpep170 (w/ Met) | A.A. | MVSGWELFKKIS |
| 2260 | NLpep171 (w/ Met) | N.A. | ATGGTGTCCGGCTGGCTGCTGTTCAAGAAAATTTCC |
| 2261 | NLpep171 (w/ Met) | A.A. | MVSGWLLFKKIS |
| 2262 | NLpep172 (w/ Met) | N.A. | ATGGTGTCCGGCTGGGTGCTGTTCAAGAAAATTTCC |
| 2263 | NLpep172 (w/ Met) | A.A. | MVSGWVLFKKIS |
| 2264 | NLpep111 (w/o Met) | N.A. | GTGACCGGCTACCGGCTGTTCGAGGAGATCAGC |
| 2265 | NLpep111 (w/o Met) | A.A. | VTGYRLFEEIS |
| 2266 | NLpep112 (w/o Met) | N.A. | GTGACCGGCTACCGGCTGTTCGAGGAGGCCAGC |
| 2267 | NLpep112 (w/o Met) | A.A. | VTGYRLFEEAS |
| 2268 | NLpep113 (w/o Met) | N.A. | GTGACCGGCTACCGGCTGTTCGAGGAGGAGAGC |
| 2269 | NLpep113 (w/o Met) | A.A. | VTGYRLFEEES |
| 2270 | NLpep114 (w/o Met) | N.A. | GTGACCGGCTACCGGCTGTTCGAGGAGATCCTG |

TABLE 1-continued

Peptide sequences

| SEQ ID NO. | PEPTIDE NO. | POLYMER | SEQUENCE |
|---|---|---|---|
| 2271 | NLpep114 (w/o Met) | A.A. | VTGYRLFEEIL |
| 2272 | NLpep115 (w/o Met) | N.A. | GTGACCGGCTACCGGCTGTTCGAGGAGGCCCTG |
| 2273 | NLpep115 (w/o Met) | A.A. | VTGYRLFEEAL |
| 2274 | NLpep116 (w/o Met) | N.A. | GTGACCGGCTACCGGCTGTTCGAGGAGGAGCTG |
| 2275 | NLpep116 (w/o Met) | A.A. | VTGYRLFEEEL |
| 2276 | NLpep117 (w/o Met) | N.A. | GTGGAGGGCTACCGGCTGTTCGAGGAGATCAGC |
| 2277 | NLpep117 (w/o Met) | A.A. | VEGYRLFEEIS |
| 2278 | NLpep118 (w/o Met) | N.A. | GTGGAGGGCTACCGGCTGTTCGAGGAGGCCAGC |
| 2279 | NLpep118 (w/o Met) | A.A. | VEGYRLFEEAS |
| 2280 | NLpep119 (w/o Met) | N.A. | GTGGAGGGCTACCGGCTGTTCGAGGAGGAGAGC |
| 2281 | NLpep119 (w/o Met) | A.A. | VEGYRLFEEES |
| 2282 | NLpep120 (w/o Met) | N.A. | GTGGAGGGCTACCGGCTGTTCGAGGAGATCCTG |
| 2283 | NLpep120 (w/o Met) | A.A. | VEGYRLFEEIL |
| 2284 | NLpep121 (w/o Met) | N.A. | GTGGAGGGCTACCGGCTGTTCGAGGAGGCCCTG |
| 2285 | NLpep121 (w/o Met) | A.A. | VEGYRLFEEAL |
| 2286 | NLpep122 (w/o Met) | N.A. | GTGGAGGGCTACCGGCTGTTCGAGGAGGAGCTG |
| 2287 | NLpep122 (w/o Met) | A.A. | VEGYRLFEEEL |
| 2288 | NLpep123 (w/o Met) | N.A. | GTGACCGGCTACCGGCTGTTCAAGAAGATCCTG |
| 2289 | NLpep123 (w/o Met) | A.A. | VTGYRLFKKIL |
| 2290 | NLpep124 (w/o Met) | N.A. | GTGACCGGCTACCGGCTGATGAAGAAGATCCTG |
| 2291 | NLpep124 (w/o Met) | A.A. | VTGYRLMKKIL |
| 2292 | NLpep125 (w/o Met) | N.A. | GTGACCGGCTACCGGCTGCACAAGAAGATCCTG |
| 2293 | NLpep125 (w/o Met) | A.A. | VTGYRLHKKIL |
| 2294 | NLpep126 (w/o Met) | N.A. | GTGACCGGCTACCGGCTGCTGAAGAAGATCCTG |
| 2295 | NLpep126 (w/o Met) | A.A. | VTGYRLLKKIL |
| 2296 | NLpep127 (w/o Met) | N.A. | GTGACCGGCTACCGGCTGAGCAAGAAGATCCTG |
| 2297 | NLpep127 (w/o Met) | A.A. | VTGYRLSKKIL |
| 2298 | NLpep128 (w/o Met) | N.A. | GTGACCGGCTACCGGCTGTTCGAGAAGATCCTG |
| 2299 | NLpep128 (w/o Met) | A.A. | VTGYRLFEKIL |
| 2300 | NLpep129 (w/o Met) | N.A. | GTGACCGGCTACCGGCTGATGGAGAAGATCCTG |
| 2301 | NLpep129 (w/o Met) | A.A. | VTGYRLMEKIL |
| 2302 | NLpep130 (w/o Met) | N.A. | GTGACCGGCTACCGGCTGCACGAGAAGATCCTG |
| 2303 | NLpep130 (w/o Met) | A.A. | VTGYRLHEKIL |
| 2304 | NLpep131 (w/o Met) | N.A. | GTGACCGGCTACCGGCTGCTGGAGAAGATCCTG |
| 2305 | NLpep131 (w/o Met) | A.A. | VTGYRLLEKIL |
| 2306 | NLpep132 (w/o Met) | N.A. | GTGACCGGCTACCGGCTGAGCGAGAAGATCCTG |
| 2307 | NLpep132 (w/o Met) | A.A. | VTGYRLSEKIL |

TABLE 1-continued

| SEQ ID NO. | PEPTIDE NO. | POLYMER | SEQUENCE |
|---|---|---|---|
| 2308 | NLpep133 (w/o Met) | N.A. | GTGACCGGCTACCGGCTGATGGAGGAGATCCTG |
| 2309 | NLpep133 (w/o Met) | A.A. | VTGYRLMEEIL |
| 2310 | NLpep134 (w/o Met) | N.A. | GTGACCGGCTACCGGCTGCACGAGGAGATCCTG |
| 2311 | NLpep134 (w/o Met) | A.A. | VTGYRLHEEIL |
| 2312 | NLpep135 (w/o Met) | N.A. | GTGACCGGCTACCGGCTGCTGGAGGAGATCCTG |
| 2313 | NLpep135 (w/o Met) | A.A. | VTGYRLLEEIL |
| 2314 | NLpep136 (w/o Met) | N.A. | GTGACCGGCTACCGGCTGAGCGAGGAGATCCTG |
| 2315 | NLpep136 (w/o Met) | A.A. | VTGYRLSEEIL |
| 2316 | NLpep137 (w/o Met) | N.A. | GTGAGCGGCTACCGGCTGTTCGAGGAGATCCTG |
| 2317 | NLpep137 (w/o Met) | A.A. | VSGYRLFEEIL |
| 2318 | NLpep138 (w/o Met) | N.A. | GTGACCGGCTGGCGGCTGTTCGAGGAGATCCTG |
| 2319 | NLpep138 (w/o Met) | A.A. | VTGWRLFEEIL |
| 2320 | NLpep139 (w/o Met) | N.A. | GTGAGCGGCTGGCGGCTGTTCGAGGAGATCCTG |
| 2321 | NLpep139 (w/o Met) | A.A. | VSGWRLFEEIL |
| 2322 | NLpep140 (w/o Met) | N.A. | AACGTGACCGGCTACCGGCTGTTCGAGGAGATCCTG |
| 2323 | NLpep140 (w/o Met) | A.A. | NVTGYRLFEEIL |
| 2324 | NLpep141 (w/o Met) | N.A. | GTGACCGGCTACCGGCTGTTCGAGGAGATCCTGAAC |
| 2325 | NLpep141 (w/o Met) | A.A. | VTGYRLFEEILN |
| 2326 | NLpep142 (w/o Met) | N.A. | AACGTGACCGGCTACCGGCTGTTCGAGGAGATCCTGAAC |
| 2327 | NLpep142 (w/o Met) | A.A. | NVTGYRLFEEILN |
| 2328 | NLpep143 (w/o Met) | N.A. | GTGACCGGCTACCGGCTGTTCGAGGAGATC |
| 2329 | NLpep143 (w/o Met) | A.A. | VTGYRLFEEI |
| 2330 | NLpep144 (w/o Met) | N.A. | GTGACCGGCTACCGGCTGTTCCAGAAGATCAGC |
| 2331 | NLpep144 (w/o Met) | A.A. | VTGYRLFQKIS |
| 2332 | NLpep145 (w/o Met) | N.A. | GTGACCGGCTACCGGCTGTTCAAGAAGATCAGCAAC |
| 2333 | NLpep145 (w/o Met) | A.A. | VTGYRLFKKISN |
| 2334 | NLpep146 (w/o Met) | N.A. | GTGACCGGCTACCGGCTGTTCAAGAAGATCAGC |
| 2335 | NLpep146 (w/o Met) | A.A. | VTGYRLFKKIS |
| 2336 | NLpep147 (w/o Met) | A.A. | VSGWRLFKKISA |
| 2337 | NLpep148 (w/o Met) | A.A. | GVSGWRLFKKIS |
| 2338 | NLpep149 (w/o Met) | A.A. | SVSGWRLFKKISN |
| 2339 | NLpep150 (w/o Met) | A.A. | SVSGWRLFKKISA |
| 2340 | NLpep151 (w/o Met) | A.A. | NSVSGWRLFKKISA |
| 2341 | NLpep152 (w/o Met) | A.A. | NSVSGWRLFKKISN |
| 2342 | NLpep153 (w/o Met) | A.A. | SNVSGWRLFKKIS |
| 2343 | NLpep154 (w/o Met) | A.A. | SGVSGWRLFKKIS |
| 2344 | NLpep155 (w/o Met) | A.A. | NSNVSGWRLFKKIS |

TABLE 1-continued

Peptide sequences

| SEQ ID NO. | PEPTIDE NO. | POLYMER | SEQUENCE |
|---|---|---|---|
| 2345 | NLpep156 (w/o Met) | A.A. | NSGVSGWRLFKKIS |
| 2346 | NLpep157 (w/o Met) | A.A. | SVSGWRLFKKIS |
| 2347 | NLpep158 (w/o Met) | A.A. | NSVSGWRLFKKIS |
| 2348 | NLpep159 (w/o Met) | A.A. | SNVSGWRLFKKISN |
| 2349 | NLpep160 (w/o Met) | A.A. | NSNVSGWRLFKKISN |
| 2350 | NLpep161 (w/o Met) | A.A. | GWRLFKK |
| 2351 | NLpep162 (w/o Met) | A.A. | GWALFKK |
| 2352 | NLpep163 (w/o Met) | A.A. | VTGWALFEEIL |
| 2353 | NLpep164 (w/o Met) | A.A. | VTGYALFQEIL |
| 2354 | NLpep165 (w/o Met) | A.A. | VTGYALFEQIL |
| 2355 | NLpep166 (w/o Met) | A.A. | VTGYALFEEIL |
| 2356 | NLpep167 (w/o Met) | N.A. | GTGTCCGGCTGGGCACTGTTCAAGAAAATTTCC |
| 2357 | NLpep167 (w/o Met) | A.A. | VSGWALFKKIS |
| 2358 | NLpep168 (w/o Met) | A.A. | VSGWKLFKKIS |
| 2359 | NLpep169 (w/o Met) | N.A. | GTGTCCGGCTGGCAGCTGTTCAAGAAAATTTCC |
| 2360 | NLpep169 (w/o Met) | A.A. | VSGWQLFKKIS |
| 2361 | NLpep170 (w/o Met) | A.A. | VSGWELFKKIS |
| 2362 | NLpep171 (w/o Met) | N.A. | GTGTCCGGCTGGCTGCTGTTCAAGAAAATTTCC |
| 2363 | NLpep171 (w/o Met) | A.A. | VSGWLLFKKIS |
| 2364 | NLpep172 (w/o Met) | N.A. | GTGTCCGGCTGGGTGCTGTTCAAGAAAATTTCC |
| 2365 | NLpep172 (w/o Met) | A.A. | VSGWVLFKKIS |

In certain embodiments, a peptide from Table 1 is provided. In some embodiments, peptides comprise a single amino acid difference from GVTGWRLCKRISA (SEQ ID NO: 236) and/or any of the peptides listed in Table 1. In some embodiments, peptides comprise two or more (e.g., 2, 3, 4, 5, 6, 7, 8, 9, 10, etc.) amino acid differences from GVTGWRLCKRISA (SEQ ID NO: 236) and/or any of the peptides listed in Table 1. In some embodiments, peptides are provided comprising one of the amino acid sequences of SEQ ID NOS: 3-438 and 2162-2365. In some embodiments, peptides are provided comprising one of the amino acid sequences of SEQ ID NOS: 3-438 and 2162-2365 with one or more additions, substitutions, and/or deletions. In some embodiments, a peptide or a portion thereof comprises greater than 70% sequence identity (e.g., 71%, 75%, 80%, 85%, 90%, 95%, 99%) with one or more of the amino acid sequence of SEQ ID NOS: 3-438 and 2162-2365. In some embodiments, nucleic acids are provided comprising one of the nucleic acid coding sequences of SEQ ID NOS: 3-438 and 2162-2365. In some embodiments, nucleic acids are provided comprising one of the nucleic acid sequences of SEQ ID NOS: 3-438 and 2162-2365 with one or more additions, substitutions, and/or deletions. In some embodiments, a nucleic acid or a portion thereof comprises greater than 70% sequence identity (e.g., 71%, 75%, 80%, 85%, 90%, 95%, 99%) with one or more of the nucleic acid sequence of SEQ ID NOS: 3-438 and 2162-2365. In some embodiments, nucleic acids are provided that code for one of the amino acid sequences of SEQ ID NOS: 3-438 and 2162-2365. In some embodiments, nucleic acids are provided that code for one of the amino acid sequences of SEQ ID NOS: 3-438 and 2162-2365 with one or more additions, substitutions, and/or deletions. In some embodiments, a nucleic acid is provided that codes for an amino acid with greater than 70% sequence identity (e.g., 71%, 75%, 80%, 85%, 90%, 95%, 99%) with one or more of the amino acid sequences of SEQ ID NOS: 3-438 and 2162-2365.

In certain embodiments, a nucleic acid from Table 1 is provided. In some embodiments, a nucleic acid encoding a peptide from Table 1 is provided. In some embodiments, a nucleic acid of the present invention codes for a peptide that comprises a single amino acid difference from MGVTGWRLCERILA (SEQ ID NO: 2) and/or any of the peptides listed in Table 1. In some embodiments, nucleic acids code for peptides comprising two or more (e.g., 2, 3, 4, 5, 6, 7, 8, 9, 10, etc.) amino acid differences from MGVTGWRLCERILA (SEQ ID NO: 2) and/or any of the peptides listed in Table 1. In some embodiments, nucleic acids are provided comprising the sequence of one of the nucleic acids in Table 1. In some embodiments, nucleic acids are provided comprising one of the nucleic acids of Table 1 with one or more additions, substitutions, and/or deletions. In some embodiments, a nucleic acid or a portion thereof comprises greater than 70% sequence identity (e.g., 71%, 75%, 80%, 85%, 90%, 95%, 99%) with one or more of the nucleic acids of Table 1.

In some embodiments, non-luminescent polypeptides that find use in embodiments of the present invention include polypeptides with one or more amino acid substitutions, deletions, or additions from SEQ ID NO: 440. In some embodiments, the present invention provides polypeptides comprising one or more of amino acid sequences of Table 2, and/or nucleic acids comprising the nucleic acid sequences of Table 2 (which code for the polypeptide sequences of Table 2).

TABLE 2

Polypeptide sequences

| SEQ ID NO | Polymer | ID |
|---|---|---|
| 441 | N.A. | R11N |
| 442 | A.A | R11N |
| 443 | N.A. | T13I |
| 444 | A.A | T13I |
| 445 | N.A. | G15S |
| 446 | A.A | G15S |
| 447 | N.A. | L18Q |
| 448 | A.A | L18Q |
| 449 | N.A. | Q20K |
| 450 | A.A | Q20K |
| 451 | N.A. | V27M |
| 452 | A.A | V27M |
| 453 | N.A. | F31I |
| 454 | A.A | F31I |
| 455 | N.A. | F31L |
| 456 | A.A | F31L |
| 457 | N.A. | F31V |
| 458 | A.A | F31V |
| 459 | N.A. | Q32R |
| 460 | A.A | Q32R |
| 461 | N.A. | N33K |
| 462 | A.A | N33K |
| 463 | N.A. | N33R |
| 464 | A.A | N33R |
| 465 | N.A. | I56N |
| 466 | A.A | I56N |
| 467 | N.A. | V58A |
| 468 | A.A | V58A |
| 469 | N.A. | I59T |
| 470 | A.A | I59T |
| 471 | N.A. | G67S |
| 472 | A.A | G67S |
| 473 | N.A. | G67D |
| 474 | A.A | G67D |
| 475 | N.A. | K75E |
| 476 | A.A | K75E |
| 477 | N.A. | M106V |
| 478 | A.A | M106V |
| 479 | N.A. | M106I |
| 480 | A.A | M106I |
| 481 | N.A. | D108N |
| 482 | A.A | D108N |
| 483 | N.A. | R112Q |
| 484 | A.A | R112Q |
| 485 | N.A. | N144T |
| 486 | A.A | N144T |
| 487 | N.A. | L149M |
| 488 | A.A | L149M |
| 489 | N.A. | N156D |
| 490 | A.A | N156D |
| 491 | N.A. | N156S |

TABLE 2-continued

Polypeptide sequences

| SEQ ID NO | Polymer | ID |
|---|---|---|
| 492 | A.A | N156S |
| 493 | N.A. | V157D |
| 494 | A.A | V157D |
| 495 | N.A. | V157S |
| 496 | A.A | V157S |
| 497 | N.A. | G8A |
| 498 | A.A | G8A |
| 499 | N.A. | G15A |
| 500 | A.A | G15A |
| 501 | N.A. | G25A |
| 502 | A.A | G25A |
| 503 | N.A. | G26A |
| 504 | A.A | G26A |
| 505 | N.A. | G35A |
| 506 | A.A | G35A |
| 507 | N.A. | G48A |
| 508 | A.A | G48A |
| 509 | N.A. | G51A |
| 510 | A.A | G51A |
| 511 | N.A. | G64A |
| 512 | A.A | G64A |
| 513 | N.A. | G67A |
| 514 | A.A | G67A |
| 515 | N.A. | G71A |
| 516 | A.A | G71A |
| 517 | N.A. | G95A |
| 518 | A.A | G95A |
| 519 | N.A. | G101A |
| 520 | A.A | G101A |
| 521 | N.A. | G111A |
| 522 | A.A | G111A |
| 523 | N.A. | G116A |
| 524 | A.A | G116A |
| 525 | N.A. | G122A |
| 526 | A.A | G122A |
| 527 | N.A. | G129A |
| 528 | A.A | G129A |
| 529 | N.A. | G134A |
| 530 | A.A | G134A |
| 531 | N.A. | G147A |
| 532 | A.A | G147A |
| 533 | N.A. | I54A |
| 534 | A.A | I54A |
| 535 | N.A. | 5A1 (G15A/D19A/G35A/G51A/G67A) |
| 536 | A.A | 5A1 (G15A/D19A/G35A/G51A/G67A) |
| 537 | N.A. | 4A1 (G15A/G35A/G67A/G71A) |
| 538 | A.A | 4A1 (G15A/G35A/G67A/G71A) |
| 539 | N.A. | 5A2 (G15A/G35A/G51A/G67A/G71A) |
| 540 | A.A | 5A2 (G15A/G35A/G51A/G67A/G71A) |
| 541 | N.A. | 5A2 + A15G |
| 542 | A.A | 5A2 + A15G |
| 543 | N.A. | 5A2 + A35G |
| 544 | A.A | 5A2 + A35G |
| 545 | N.A. | 5A2 + A51G |
| 546 | A.A | 5A2 + A51G |
| 547 | N.A. | 5A2 + A67G |
| 548 | A.A | 5A2 + A67G |
| 549 | N.A. | 5A2 + A71G |
| 550 | A.A | 5A2 + A71G |
| 551 | N.A. | 5A2 + R11A |
| 552 | A.A | 5A2 + R11A |
| 553 | N.A. | 5A2 + R11C |

TABLE 2-continued

Polypeptide sequences

| SEQ ID NO | Polymer | ID |
|---|---|---|
| 554 | A.A | 5A2 + R11C |
| 555 | N.A. | 5A2 + R11D |
| 556 | A.A | 5A2 + R11D |
| 557 | N.A. | 5A2 + R11E |
| 558 | A.A | 5A2 + R11E |
| 559 | N.A. | 5A2 + R11F |
| 560 | A.A | 5A2 + R11F |
| 561 | N.A. | 5A2 + R11G |
| 562 | A.A | 5A2 + R11G |
| 563 | N.A. | 5A2 + R11H |
| 564 | A.A | 5A2 + R11H |
| 565 | N.A. | 5A2 + R11I |
| 566 | A.A | 5A2 + R11I |
| 567 | N.A. | 5A2 + R11K |
| 568 | A.A | 5A2 + R11K |
| 569 | N.A. | 5A2 + R11L |
| 570 | A.A | 5A2 + R11L |
| 571 | N.A. | 5A2 + R11M |
| 572 | A.A | 5A2 + R11M |
| 573 | N.A. | 5A2 + R11N |
| 574 | A.A | 5A2 + R11N |
| 575 | N.A. | 5A2 + R11P |
| 576 | A.A | 5A2 + R11P |
| 577 | N.A. | 5A2 + R11Q |
| 578 | A.A | 5A2 + R11Q |
| 579 | N.A. | 5A2 + R11S |
| 580 | A.A | 5A2 + R11S |
| 581 | N.A. | 5A2 + R11T |
| 582 | A.A | 5A2 + R11T |
| 583 | N.A. | 5A2 + R11V |
| 584 | A.A | 5A2 + R11V |
| 585 | N.A. | 5A2 + R11W |
| 586 | A.A | 5A2 + R11W |
| 587 | N.A. | 5A2 + R11Y |
| 588 | A.A | 5A2 + R11Y |
| 589 | N.A. | 5A2 + A15C |
| 590 | A.A | 5A2 + A15C |
| 591 | N.A. | 5A2 + A15D |
| 592 | A.A | 5A2 + A15D |
| 593 | N.A. | 5A2 + A15E |
| 594 | A.A | 5A2 + A15E |
| 595 | N.A. | 5A2 + A15F |
| 596 | A.A | 5A2 + A15F |
| 597 | N.A. | 5A2 + A15G |
| 598 | A.A | 5A2 + A15G |
| 599 | N.A. | 5A2 + A15H |
| 600 | A.A | 5A2 + A15H |
| 601 | N.A. | 5A2 + A15I |
| 602 | A.A | 5A2 + A15I |
| 603 | N.A. | 5A2 + A15K |
| 604 | A.A | 5A2 + A15K |
| 605 | N.A. | 5A2 + A15L |
| 606 | A.A | 5A2 + A15L |
| 607 | N.A. | 5A2 + A15M |
| 608 | A.A | 5A2 + A15M |
| 609 | N.A. | 5A2 + A15N |
| 610 | A.A | 5A2 + A15N |
| 611 | N.A. | 5A2 + A15P |
| 612 | A.A | 5A2 + A15P |
| 613 | N.A. | 5A2 + A15Q |
| 614 | A.A | 5A2 + A15Q |
| 615 | N.A. | 5A2 + A15R |
| 616 | A.A | 5A2 + A15R |
| 617 | N.A. | 5A2 + A15S |
| 618 | A.A | 5A2 + A15S |
| 619 | N.A. | 5A2 + A15T |
| 620 | A.A | 5A2 + A15T |
| 621 | N.A. | 5A2 + A15V |
| 622 | A.A | 5A2 + A15V |
| 623 | N.A. | 5A2 + A15W |
| 624 | A.A | 5A2 + A15W |
| 625 | N.A. | 5A2 + A15Y |
| 626 | A.A | 5A2 + A15Y |
| 627 | N.A. | 5A2 + L18A |
| 628 | A.A | 5A2 + L18A |
| 629 | N.A. | 5A2 + L18C |
| 630 | A.A | 5A2 + L18C |
| 631 | N.A. | 5A2 + L18D |
| 632 | A.A | 5A2 + L18D |
| 633 | N.A. | 5A2 + L18E |
| 634 | A.A | 5A2 + L18E |
| 635 | N.A. | 5A2 + L18F |
| 636 | A.A | 5A2 + L18F |
| 637 | N.A. | 5A2 + L18G |
| 638 | A.A | 5A2 + L18G |
| 639 | N.A. | 5A2 + L18H |
| 640 | A.A | 5A2 + L18H |
| 641 | N.A. | 5A2 + L18I |
| 642 | A.A | 5A2 + L18I |
| 643 | N.A. | 5A2 + L18K |
| 644 | A.A | 5A2 + L18K |
| 645 | N.A. | 5A2 + L18M |
| 646 | A.A | 5A2 + L18M |
| 647 | N.A. | 5A2 + L18N |
| 648 | A.A | 5A2 + L18N |
| 649 | N.A. | 5A2 + L18P |
| 650 | A.A | 5A2 + L18P |
| 651 | N.A. | 5A2 + L18Q |
| 652 | A.A | 5A2 + L18Q |
| 653 | N.A. | 5A2 + L18R |
| 654 | A.A | 5A2 + L18R |
| 655 | N.A. | 5A2 + L18S |
| 656 | A.A | 5A2 + L18S |
| 657 | N.A. | 5A2 + L18T |
| 658 | A.A | 5A2 + L18T |
| 659 | N.A. | 5A2 + L18V |
| 660 | A.A | 5A2 + L18V |
| 661 | N.A. | 5A2 + L18W |
| 662 | A.A | 5A2 + L18W |
| 663 | N.A. | 5A2 + L18Y |
| 664 | A.A | 5A2 + L18Y |
| 665 | N.A. | 5A2 + F31A |
| 666 | A.A | 5A2 + F31A |
| 667 | N.A. | 5A2 + F31C |
| 668 | A.A | 5A2 + F31C |
| 669 | N.A. | 5A2 + F31D |
| 670 | A.A | 5A2 + F31D |
| 671 | N.A. | 5A2 + F31E |
| 672 | A.A | 5A2 + F31E |
| 673 | N.A. | 5A2 + F31G |
| 674 | A.A | 5A2 + F31G |
| 675 | N.A. | 5A2 + F31H |
| 676 | A.A | 5A2 + F31H |
| 677 | N.A. | 5A2 + F31I |
| 678 | A.A | 5A2 + F31I |
| 679 | N.A. | 5A2 + F31K |
| 680 | A.A | 5A2 + F31K |
| 681 | N.A. | 5A2 + F31L |
| 682 | A.A | 5A2 + F31L |
| 683 | N.A. | 5A2 + F31M |
| 684 | A.A | 5A2 + F31M |
| 685 | N.A. | 5A2 + F31N |
| 686 | A.A | 5A2 + F31N |
| 687 | N.A. | 5A2 + F31P |
| 688 | A.A | 5A2 + F31P |
| 689 | N.A. | 5A2 + F31Q |
| 690 | A.A | 5A2 + F31Q |
| 691 | N.A. | 5A2 + F31R |
| 692 | A.A | 5A2 + F31R |
| 693 | N.A. | 5A2 + F31S |
| 694 | A.A | 5A2 + F31S |
| 695 | N.A. | 5A2 + F31T |
| 696 | A.A | 5A2 + F31T |
| 697 | N.A. | 5A2 + F31V |
| 698 | A.A | 5A2 + F31V |
| 699 | N.A. | 5A2 + F31W |
| 700 | A.A | 5A2 + F31W |
| 701 | N.A. | 5A2 + F31Y |

TABLE 2-continued

Polypeptide sequences

| SEQ ID NO | Polymer | ID |
|---|---|---|
| 702 | A.A | 5A2 + F31Y |
| 703 | N.A. | 5A2 + V58A |
| 704 | A.A | 5A2 + V58A |
| 705 | N.A. | 5A2 + V58C |
| 706 | A.A | 5A2 + V58C |
| 707 | N.A. | 5A2 + V58D |
| 708 | A.A | 5A2 + V58D |
| 709 | N.A. | 5A2 + V58E |
| 710 | A.A | 5A2 + V58E |
| 711 | N.A. | 5A2 + V58F |
| 712 | A.A | 5A2 + V58F |
| 713 | N.A. | 5A2 + V58G |
| 714 | A.A | 5A2 + V58G |
| 715 | N.A. | 5A2 + V58H |
| 716 | A.A | 5A2 + V58H |
| 717 | N.A. | 5A2 + V58I |
| 718 | A.A | 5A2 + V58I |
| 719 | N.A. | 5A2 + V58K |
| 720 | A.A | 5A2 + V58K |
| 721 | N.A. | 5A2 + V58L |
| 722 | A.A | 5A2 + V58L |
| 723 | N.A. | 5A2 + V58M |
| 724 | A.A | 5A2 + V58M |
| 725 | N.A. | 5A2 + V58N |
| 726 | A.A | 5A2 + V58N |
| 727 | N.A. | 5A2 + V58P |
| 728 | A.A | 5A2 + V58P |
| 729 | N.A. | 5A2 + V58Q |
| 730 | A.A | 5A2 + V58Q |
| 731 | N.A. | 5A2 + V58R |
| 732 | A.A | 5A2 + V58R |
| 733 | N.A. | 5A2 + V58S |
| 734 | A.A | 5A2 + V58S |
| 735 | N.A. | 5A2 + V58T |
| 736 | A.A | 5A2 + V58T |
| 737 | N.A. | 5A2 + V58W |
| 738 | A.A | 5A2 + V58W |
| 739 | N.A. | 5A2 + V58Y |
| 740 | A.A | 5A2 + V58Y |
| 741 | N.A. | 5A2 + A67C |
| 742 | A.A | 5A2 + A67C |
| 743 | N.A. | 5A2 + A67D |
| 744 | A.A | 5A2 + A67D |
| 745 | N.A. | 5A2 + A67E |
| 746 | A.A | 5A2 + A67E |
| 747 | N.A. | 5A2 + A67F |
| 748 | A.A | 5A2 + A67F |
| 749 | N.A. | 5A2 + A67G |
| 750 | A.A | 5A2 + A67G |
| 751 | N.A. | 5A2 + A67H |
| 752 | A.A | 5A2 + A67H |
| 753 | N.A. | 5A2 + A67I |
| 754 | A.A | 5A2 + A67I |
| 755 | N.A. | 5A2 + A67K |
| 756 | A.A | 5A2 + A67K |
| 757 | N.A. | 5A2 + A67L |
| 758 | A.A | 5A2 + A67L |
| 759 | N.A. | 5A2 + A67M |
| 760 | A.A | 5A2 + A67M |
| 761 | N.A. | 5A2 + A67N |
| 762 | A.A | 5A2 + A67N |
| 763 | N.A. | 5A2 + A67P |
| 764 | A.A | 5A2 + A67P |
| 765 | N.A. | 5A2 + A67Q |
| 766 | A.A | 5A2 + A67Q |
| 767 | N.A. | 5A2 + A67R |
| 768 | A.A | 5A2 + A67R |
| 769 | N.A. | 5A2 + A67S |
| 770 | A.A | 5A2 + A67S |
| 771 | N.A. | 5A2 + A67T |
| 772 | A.A | 5A2 + A67T |
| 773 | N.A. | 5A2 + A67V |
| 774 | A.A | 5A2 + A67V |
| 775 | N.A. | 5A2 + A67W |
| 776 | A.A | 5A2 + A67W |
| 777 | N.A. | 5A2 + A67Y |
| 778 | A.A | 5A2 + A67Y |
| 779 | N.A. | 5A2 + M106A |
| 780 | A.A | 5A2 + M106A |
| 781 | N.A. | 5A2 + M106C |
| 782 | A.A | 5A2 + M106C |
| 783 | N.A. | 5A2 + M106D |
| 784 | A.A | 5A2 + M106D |
| 785 | N.A. | 5A2 + M106E |
| 786 | A.A | 5A2 + M106E |
| 787 | N.A. | 5A2 + M106F |
| 788 | A.A | 5A2 + M106F |
| 789 | N.A. | 5A2 + M106G |
| 790 | A.A | 5A2 + M106G |
| 791 | N.A. | 5A2 + M106H |
| 792 | A.A | 5A2 + M106H |
| 793 | N.A. | 5A2 + M106I |
| 794 | A.A | 5A2 + M106I |
| 795 | N.A. | 5A2 + M106K |
| 796 | A.A | 5A2 + M106K |
| 797 | N.A. | 5A2 + M106L |
| 798 | A.A | 5A2 + M106L |
| 799 | N.A. | 5A2 + M106N |
| 800 | A.A | 5A2 + M106N |
| 801 | N.A. | 5A2 + M106P |
| 802 | A.A | 5A2 + M106P |
| 803 | N.A. | 5A2 + M106Q |
| 804 | A.A | 5A2 + M106Q |
| 805 | N.A. | 5A2 + M106R |
| 806 | A.A | 5A2 + M106R |
| 807 | N.A. | 5A2 + M106S |
| 808 | A.A | 5A2 + M106S |
| 809 | N.A. | 5A2 + M106T |
| 810 | A.A | 5A2 + M106T |
| 811 | N.A. | 5A2 + M106V |
| 812 | A.A | 5A2 + M106V |
| 813 | N.A. | 5A2 + M106W |
| 814 | A.A | 5A2 + M106W |
| 815 | N.A. | 5A2 + M106Y |
| 816 | A.A | 5A2 + M106Y |
| 817 | N.A. | 5A2 + L149A |
| 818 | A.A | 5A2 + L149A |
| 819 | N.A. | 5A2 + L149C |
| 820 | A.A | 5A2 + L149C |
| 821 | N.A. | 5A2 + L149D |
| 822 | A.A | 5A2 + L149D |
| 823 | N.A. | 5A2 + L149E |
| 824 | A.A | 5A2 + L149E |
| 825 | N.A. | 5A2 + L149F |
| 826 | A.A | 5A2 + L149F |
| 827 | N.A. | 5A2 + L149G |
| 828 | A.A | 5A2 + L149G |
| 829 | N.A. | 5A2 + L149H |
| 830 | A.A | 5A2 + L149H |
| 831 | N.A. | 5A2 + L149I |
| 832 | A.A | 5A2 + L149I |
| 833 | N.A. | 5A2 + L149K |
| 834 | A.A | 5A2 + L149K |
| 835 | N.A. | 5A2 + L149M |
| 836 | A.A | 5A2 + L149M |
| 837 | N.A. | 5A2 + L149N |
| 838 | A.A | 5A2 + L149N |
| 839 | N.A. | 5A2 + L149P |
| 840 | A.A | 5A2 + L149P |
| 841 | N.A. | 5A2 + L149Q |
| 842 | A.A | 5A2 + L149Q |
| 843 | N.A. | 5A2 + L149R |
| 844 | A.A | 5A2 + L149R |
| 845 | N.A. | 5A2 + L149S |
| 846 | A.A | 5A2 + L149S |
| 847 | N.A. | 5A2 + L149T |
| 848 | A.A | 5A2 + L149T |
| 849 | N.A. | 5A2 + L149V |

TABLE 2-continued

Polypeptide sequences

| SEQ ID NO | Polymer | ID |
|---|---|---|
| 850 | A.A | 5A2 + L149V |
| 851 | N.A. | 5A2 + L149W |
| 852 | A.A | 5A2 + L149W |
| 853 | N.A. | 5A2 + L149Y |
| 854 | A.A | 5A2 + L149Y |
| 855 | N.A. | 5A2 + V157A |
| 856 | A.A | 5A2 + V157A |
| 857 | N.A. | 5A2 + V157C |
| 858 | A.A | 5A2 + V157C |
| 859 | N.A. | 5A2 + V157D |
| 860 | A.A | 5A2 + V157D |
| 861 | N.A. | 5A2 + V157E |
| 862 | A.A | 5A2 + V157E |
| 863 | N.A. | 5A2 + V157F |
| 864 | A.A | 5A2 + V157F |
| 865 | N.A. | 5A2 + V157G |
| 866 | A.A | 5A2 + V157G |
| 867 | N.A. | 5A2 + V157H |
| 868 | A.A | 5A2 + V157H |
| 869 | N.A. | 5A2 + V157I |
| 870 | A.A | 5A2 + V157I |
| 871 | N.A. | 5A2 + V157K |
| 872 | A.A | 5A2 + V157K |
| 873 | N.A. | 5A2 + V157L |
| 874 | A.A | 5A2 + V157L |
| 875 | N.A. | 5A2 + V157M |
| 876 | A.A | 5A2 + V157M |
| 877 | N.A. | 5A2 + V157N |
| 878 | A.A | 5A2 + V157N |
| 879 | N.A. | 5A2 + V157P |
| 880 | A.A | 5A2 + V157P |
| 881 | N.A. | 5A2 + V157Q |
| 882 | A.A | 5A2 + V157Q |
| 883 | N.A. | 5A2 + V157R |
| 884 | A.A | 5A2 + V157R |
| 885 | N.A. | 5A2 + V157S |
| 886 | A.A | 5A2 + V157S |
| 887 | N.A. | 5A2 + V157T |
| 888 | A.A | 5A2 + V157T |
| 889 | N.A. | 5A2 + V157W |
| 890 | A.A | 5A2 + V157W |
| 891 | N.A. | 5A2 + V157Y |
| 892 | A.A | 5A2 + V157Y |
| 893 | N.A. | 5A2 + Q20K |
| 894 | A.A | 5A2 + Q20K |
| 895 | N.A. | 5A2 + V27M |
| 896 | A.A | 5A2 + V27M |
| 897 | N.A. | 5A2 + N33K |
| 898 | A.A | 5A2 + N33K |
| 899 | N.A. | 5A2 + V38I |
| 900 | A.A | 5A2 + V38I |
| 901 | N.A. | 5A2 + I56N |
| 902 | A.A | 5A2 + I56N |
| 903 | N.A. | 5A2 + D108N |
| 904 | A.A | 5A2 + D108N |
| 905 | N.A. | 5A2 + N144T |
| 906 | A.A | 5A2 + N144T |
| 907 | N.A. | 5A2 + V27M + A35G |
| 908 | A.A | 5A2 + V27M + A35G |
| 909 | N.A. | 5A2 + A71G + K75E |
| 910 | A.A | 5A2 + A71G + K75E |
| 911 | N.A. | 5A2 + R11E + L149M |
| 912 | A.A | 5A2 + R11E + L149M |
| 913 | N.A. | 5A2 + R11E + V157P |
| 914 | A.A | 5A2 + R11E + V157P |
| 915 | N.A. | 5A2 + D108N + N144T |
| 916 | A.A | 5A2 + D108N + N144T |
| 917 | N.A. | 5A2 + L149M + V157D |
| 918 | A.A | 5A2 + L149M + V157D |
| 919 | N.A. | 5A2 + L149M + V157P |
| 920 | A.A | 5A2 + L149M + V157P |
| 921 | N.A. | 3P (5A2 + R11E + L149M + V157P) |
| 922 | A.A | 3P (5A2 + R11E + L149M + V157P) |
| 923 | N.A. | 3P + D108N |
| 924 | A.A | 3P + D108N |
| 925 | N.A. | 3P + N144T |
| 926 | A.A | 3P + N144T |
| 927 | N.A. | 3E (5A2 + R11E + L149M + V157E) |
| 928 | A.A | 3E (5A2 + R11E + L149M + V157E) |
| 929 | N.A. | 3E + D108N |
| 930 | A.A | 3E + D108N |
| 931 | N.A. | 3E + N144T |
| 932 | A.A | 3E + N144T |
| 933 | N.A. | 5P (3P + D108N + N144T) |
| 934 | A.A | 5P (3P + D108N + N144T) |
| 935 | N.A. | 6P (5P + I56N) |
| 936 | A.A | 6P (5P + I56N) |
| 937 | N.A. | 5E (3E + D108N + N144T) |
| 938 | A.A | 5E (3E + D108N + N144T) |
| 939 | N.A. | 6E (5E + I56N) |
| 940 | A.A | 6E (5E + I56N) |
| 941 | N.A. | NLpoly1 (5A2 + R11N + A15S + L18Q + F31I + V58A + A67D + M106V + L149M + V157D) |
| 942 | A.A | NLpoly1 (5A2 + R11N + A15S + L18Q + F31I + V58A + A67D + M106V + L149M + V157D) |
| 943 | N.A. | NLpoly2 (5A2 + A15S + L18Q + F31I + V58A + A67D + M106V + L149M + V157D) |
| 944 | A.A | NLpoly2 (5A2 + A15S + |

TABLE 2-continued

Polypeptide sequences

| SEQ ID NO | Polymer | ID |
|---|---|---|
| 945 | N.A. | L18Q + F31I + V58A + A67D + M106V + L149M + V157D) NLpoly3 (5A2 + R11N + L18Q + F31I + V58A + A67D + M106V + L149M + V157D) |
| 946 | A.A | NLpoly3 (5A2 + R11N + L18Q + F31I + V58A + A67D + M106V + L149M + V157D) |
| 947 | N.A. | NLpoly4 (5A2 + R11N + A15S + F31I + V58A + A67D + M106V + L149M + V157D) |
| 948 | A.A | NLpoly4 (5A2 + R11N + A15S + F31I + V58A + A67D + M106V + L149M + V157D) |
| 949 | N.A. | NLpoly5 (5A2 + R11N + A15S + L18Q + V58A + A67D + M106V + L149M + V157D) |
| 950 | A.A | NLpoly5 (5A2 + R11N + A15S + L18Q + V58A + A67D + M106V + L149M + V157D) |
| 951 | N.A. | NLpoly6 (5A2 + R11N + A15S + L18Q + F31I + A67D + M106V + L149M + V157D) |
| 952 | A.A | NLpoly6 (5A2 + R11N + A15S + L18Q + F31I + A67D + M106V + L149M + V157D) |
| 953 | N.A. | NLpoly7 (5A2 + R11N + A15S + L18Q + F31I + V58A + M106V + L149M + V157D) |
| 954 | A.A | NLpoly7 (5A2 + R11N + A15S + L18Q + F31I + V58A + M106V + L149M + V157D) |
| 955 | N.A. | NLpoly8 (5A2 + R11N + A15S + L18Q + F31I + V58A + A67D + L149M + V157D) |
| 956 | A.A | NLpoly8 (5A2 + R11N + A15S + L18Q + F31I + V58A + |

TABLE 2-continued

Polypeptide sequences

| SEQ ID NO | Polymer | ID |
|---|---|---|
| | | A67D + L149M + V157D) |
| 957 | N.A. | NLpoly9 (5A2 + R11N + A15S + L18Q + F31I + V58A + A67D + M106V + V157D) |
| 958 | A.A | NLpoly9 (5A2 + R11N + A15S + L18Q + F31I + V58A + A67D + M106V + V157D) |
| 959 | N.A. | NLpoly10 (5A2 + R11N + A15S + L18Q + F31I + V58A + A67D + M106V + L149M) |
| 960 | A.A | NLpoly10 (5A2 + R11N + A15S + L18Q + F31I + V58A + A67D + M106V + L149M) |
| 961 | N.A. | NLpoly11 (5A2 + A15S + L18Q + M106V + L149M + V157D) |
| 962 | A.A | NLpoly11 (5A2 + A15S + L18Q + M106V + L149M + V157D) |
| 963 | N.A. | NLpoly12 (5A2 + A15S + L18Q + A67D + M106V + L149M + V157D) |
| 964 | A.A | NLpoly12 (5A2 + A15S + L18Q + A67D + M106V + L149M + V157D) |
| 965 | N.A. | NLpoly13 (5A2 + R11N + A15S + L18Q + M106V + L149M + V157D) |
| 966 | A.A | NLpoly13 (5A2 + R11N + A15S + L18Q + M106V + L149M + V157D) |
| 967 | N.A. | 5P + V |
| 968 | A.A | 5P + V |
| 969 | N.A. | 5P + A |
| 970 | A.A | 5P + A |
| 971 | N.A. | 5P + VT |
| 972 | A.A | 5P + VT |
| 973 | N.A. | 5P + VA |
| 974 | A.A | 5P + VA |
| 975 | N.A. | 5P + AT |
| 976 | A.A | 5P + AT |
| 977 | N.A. | 5P + AA |
| 978 | A.A | 5P + AA |
| 979 | N.A. | 5P + GG |
| 980 | A.A | 5P + GG |
| 981 | N.A. | 5P + AA |
| 982 | A.A | 5P + AA |
| 983 | N.A. | 5P + ATG |
| 984 | A.A | 5P + ATG |

TABLE 2-continued

Polypeptide sequences

| SEQ ID NO | Polymer | ID |
|---|---|---|
| 985 | N.A. | 5P + VTG |
| 986 | A.A | 5P + VTG |
| 987 | N.A. | 5P + VTA |
| 988 | A.A | 5P + VTA |
| 989 | N.A. | 5P + GTA |
| 990 | A.A | 5P + GTA |
| 991 | N.A. | 5P + VTGW |
| 992 | A.A | 5P + VTGW |
| 993 | N.A. | 5P + VTGWR |
| 994 | A.A | 5P + VTGWR |
| 995 | N.A. | 5P + VTGWE |
| 996 | A.A | 5P + VTGWE |
| 997 | N.A. | 5P + VTGWK |
| 998 | A.A | 5P + VTGWK |
| 999 | N.A. | 5P + VTGWQ |
| 1000 | A.A | 5P + VTGWQ |
| 1001 | N.A. | 5P + VTGWH |
| 1002 | A.A | 5P + VTGWH |
| 1003 | N.A. | 5P D1 (-157) |
| 1004 | A.A | 5P D1 (-157) |
| 1005 | N.A. | 5P D2 (-156-157) |
| 1006 | A.A | 5P D2 (-156-157) |
| 1007 | N.A. | 5P D3 (-155-157) |
| 1008 | A.A | 5P D3 (-155-157) |
| 1009 | N.A. | 5P D4 (-154-157) |
| 1010 | A.A | 5P D4 (-154-157) |
| 1011 | N.A. | 5P D5 (-153-157) |
| 1012 | A.A | 5P D5 (-153-157) |
| 1013 | N.A. | 5P D6 (-152-157) |
| 1014 | A.A | 5P D6 (-152-157) |
| 1015 | N.A. | 5P D7 (-151-157) |
| 1016 | A.A | 5P D7 (-151-157) |
| 1017 | N.A. | 5P + F31A |
| 1018 | A.A | 5P + F31A |
| 1019 | N.A. | 5P + F31C |
| 1020 | A.A | 5P + F31C |
| 1021 | N.A. | 5P + F31D |
| 1022 | A.A | 5P + F31D |
| 1023 | N.A. | 5P + F31E |
| 1024 | A.A | 5P + F31E |
| 1025 | N.A. | 5P + F31G |
| 1026 | A.A | 5P + F31G |
| 1027 | N.A. | 5P + F31H |
| 1028 | A.A | 5P + F31H |
| 1029 | N.A. | 5P + F31I |
| 1030 | A.A | 5P + F31I |
| 1031 | N.A. | 5P + F31K |
| 1032 | A.A | 5P + F31K |
| 1033 | N.A. | 5P + F31L |
| 1034 | A.A | 5P + F31L |
| 1035 | N.A. | 5P + F31M |
| 1036 | A.A | 5P + F31M |
| 1037 | N.A. | 5P + F31N |
| 1038 | A.A | 5P + F31N |
| 1039 | N.A. | 5P + F31P |
| 1040 | A.A | 5P + F31P |
| 1041 | N.A. | 5P + F31Q |
| 1042 | A.A | 5P + F31Q |
| 1043 | N.A. | 5P + F31R |
| 1044 | A.A | 5P + F31R |
| 1045 | N.A. | 5P + F31S |
| 1046 | A.A | 5P + F31S |
| 1047 | N.A. | 5P + F31T |
| 1048 | A.A | 5P + F31T |
| 1049 | N.A. | 5P + F31V |
| 1050 | A.A | 5P + F31V |
| 1051 | N.A. | 5P + F31W |
| 1052 | A.A | 5P + F31W |
| 1053 | N.A. | 5P + F31Y |
| 1054 | A.A | 5P + F31Y |
| 1055 | N.A. | 5P + L46A |
| 1056 | A.A | 5P + L46A |
| 1057 | N.A. | 5P + L46C |
| 1058 | A.A | 5P + L46C |
| 1059 | N.A. | 5P + L46D |
| 1060 | A.A | 5P + L46D |
| 1061 | N.A. | 5P + L46E |
| 1062 | A.A | 5P + L46E |
| 1063 | N.A. | 5P + L46F |
| 1064 | A.A | 5P + L46F |
| 1065 | N.A. | 5P + L46G |
| 1066 | A.A | 5P + L46G |
| 1067 | N.A. | 5P + L46H |
| 1068 | A.A | 5P + L46H |
| 1069 | N.A. | 5P + L46I |
| 1070 | A.A | 5P + L46I |
| 1071 | N.A. | 5P + L46K |
| 1072 | A.A | 5P + L46K |
| 1073 | N.A. | 5P + L46M |
| 1074 | A.A | 5P + L46M |
| 1075 | N.A. | 5P + L46N |
| 1076 | A.A | 5P + L46N |
| 1077 | N.A. | 5P + L46P |
| 1078 | A.A | 5P + L46P |
| 1079 | N.A. | 5P + L46Q |
| 1080 | A.A | 5P + L46Q |
| 1081 | N.A. | 5P + L46R |
| 1082 | A.A | 5P + L46R |
| 1083 | N.A. | 5P + L46S |
| 1084 | A.A | 5P + L46S |
| 1085 | N.A. | 5P + L46T |
| 1086 | A.A | 5P + L46T |
| 1087 | N.A. | 5P + L46V |
| 1088 | A.A | 5P + L46V |
| 1089 | N.A. | 5P + L46W |
| 1090 | A.A | 5P + L46W |
| 1091 | N.A. | 5P + L46Y |
| 1092 | A.A | 5P + L46Y |
| 1093 | N.A. | 5P + N108A |
| 1094 | A.A | 5P + N108A |
| 1095 | N.A. | 5P + N108C |
| 1096 | A.A | 5P + N108C |
| 1097 | N.A. | 5P + N108D |
| 1098 | A.A | 5P + N108D |
| 1099 | N.A. | 5P + N108E |
| 1100 | A.A | 5P + N108E |
| 1101 | N.A. | 5P + N108F |
| 1102 | A.A | 5P + N108F |
| 1103 | N.A. | 5P + N108G |
| 1104 | A.A | 5P + N108G |
| 1105 | N.A. | 5P + N108H |
| 1106 | A.A | 5P + N108H |
| 1107 | N.A. | 5P + N108I |
| 1108 | A.A | 5P + N108I |
| 1109 | N.A. | 5P + N108K |
| 1110 | A.A | 5P + N108K |
| 1111 | N.A. | 5P + N108L |
| 1112 | A.A | 5P + N108L |
| 1113 | N.A. | 5P + N108M |
| 1114 | A.A | 5P + N108M |
| 1115 | N.A. | 5P + N108P |
| 1116 | A.A | 5P + N108P |
| 1117 | N.A. | 5P + N108Q |
| 1118 | A.A | 5P + N108Q |
| 1119 | N.A. | 5P + N108R |
| 1120 | A.A | 5P + N108R |
| 1121 | N.A. | 5P + N108S |
| 1122 | A.A | 5P + N108S |
| 1123 | N.A. | 5P + N108T |
| 1124 | A.A | 5P + N108T |
| 1125 | N.A. | 5P + N108V |
| 1126 | A.A | 5P + N108V |
| 1127 | N.A. | 5P + N108W |
| 1128 | A.A | 5P + N108W |
| 1129 | N.A. | 5P + N108Y |
| 1130 | A.A | 5P + N108Y |
| 1131 | N.A. | 5P + T144A |
| 1132 | A.A | 5P + T144A |

TABLE 2-continued

Polypeptide sequences

| SEQ ID NO | Polymer | ID |
|---|---|---|
| 1133 | N.A. | 5P + T144C |
| 1134 | A.A | 5P + T144C |
| 1135 | N.A. | 5P + T144D |
| 1136 | A.A | 5P + T144D |
| 1137 | N.A. | 5P + T144E |
| 1138 | A.A | 5P + T144E |
| 1139 | N.A. | 5P + T144F |
| 1140 | A.A | 5P + T144F |
| 1141 | N.A. | 5P + T144G |
| 1142 | A.A | 5P + T144G |
| 1143 | N.A. | 5P + T144H |
| 1144 | A.A | 5P + T144H |
| 1145 | N.A. | 5P + T144I |
| 1146 | A.A | 5P + T144I |
| 1147 | N.A. | 5P + T144K |
| 1148 | A.A | 5P + T144K |
| 1149 | N.A. | 5P + T144L |
| 1150 | A.A | 5P + T144L |
| 1151 | N.A. | 5P + T144M |
| 1152 | A.A | 5P + T144M |
| 1153 | N.A. | 5P + T144N |
| 1154 | A.A | 5P + T144N |
| 1155 | N.A. | 5P + T144P |
| 1156 | A.A | 5P + T144P |
| 1157 | N.A. | 5P + T144Q |
| 1158 | A.A | 5P + T144Q |
| 1159 | N.A. | 5P + T144R |
| 1160 | A.A | 5P + T144R |
| 1161 | N.A. | 5P + T144S |
| 1440 | A.A | 5P + T144S |
| 1163 | N.A. | 5P + T144V |
| 1164 | A.A | 5P + T144V |
| 1165 | N.A. | 5P + T144W |
| 1166 | A.A | 5P + T144W |
| 1167 | N.A. | 5P + T144Y |
| 1168 | A.A | 5P + T144Y |
| 1169 | N.A. | 5P + P157A |
| 1170 | A.A | 5P + P157A |
| 1171 | N.A. | 5P + P157C |
| 1172 | A.A | 5P + P157C |
| 1173 | N.A. | 5P + P157D |
| 1174 | A.A | 5P + P157D |
| 1175 | N.A. | 5P + P157E |
| 1176 | A.A | 5P + P157E |
| 1177 | N.A. | 5P + P157F |
| 1178 | A.A | 5P + P157F |
| 1179 | N.A. | 5P + P157G |
| 1180 | A.A | 5P + P157G |
| 1181 | N.A. | 5P + P157H |
| 1182 | A.A | 5P + P157H |
| 1183 | N.A. | 5P + P157I |
| 1184 | A.A | 5P + P157I |
| 1185 | N.A. | 5P + P157K |
| 1186 | A.A | 5P + P157K |
| 1187 | N.A. | 5P + P157L |
| 1188 | A.A | 5P + P157L |
| 1189 | N.A. | 5P + P157M |
| 1190 | A.A | 5P + P157M |
| 1191 | N.A. | 5P + P157N |
| 1192 | A.A | 5P + P157N |
| 1193 | N.A. | 5P + P157Q |
| 1194 | A.A | 5P + P157Q |
| 1195 | N.A. | 5P + P157R |
| 1196 | A.A | 5P + P157R |
| 1197 | N.A. | 5P + P157S |
| 1198 | A.A | 5P + P157S |
| 1199 | N.A. | 5P + P157T |
| 1200 | A.A | 5P + P157T |
| 1201 | N.A. | 5P + P157V |
| 1202 | A.A | 5P + P157V |
| 1203 | N.A. | 5P + P157W |
| 1204 | A.A | 5P + P157W |
| 1205 | N.A. | 5P + P157Y |
| 1206 | A.A | 5P + P157Y |
| 1207 | N.A. | 5P + I107L |
| 1208 | A.A | 5P + I107L |
| 1209 | N.A. | 5P + K75E |
| 1210 | A.A | 5P + K75E |
| 1211 | N.A. | 5P + K123E + N156D |
| 1212 | A.A | 5P + K123E + N156D |
| 1213 | N.A. | 5P + I76V |
| 1214 | A.A | 5P + I76V |
| 1215 | N.A. | 5P + G48D + H57R + L92M + I99V |
| 1216 | A.A | 5P + G48D + H57R + L92M + I99V |
| 1217 | N.A. | 5P + F31L + V36A + I99V |
| 1218 | A.A | 5P + F31L + V36A + I99V |
| 1219 | N.A. | 5P + F31L + H93P |
| 1220 | A.A | 5P + F31L + H93P |
| 1221 | N.A. | 5P + V90A |
| 1222 | A.A | 5P + V90A |
| 1223 | N.A. | 5P + I44V |
| 1224 | A.A | 5P + I44V |
| 1225 | N.A. | 5P + L46R + H86Q + M106V |
| 1226 | A.A | 5P + L46R + H86Q + M106V |
| 1227 | N.A. | 5P + R141H |
| 1228 | A.A | 5P + R141H |
| 1229 | N.A. | 5P + N33D + V58A |
| 1230 | A.A | 5P + N33D + V58A |
| 1231 | N.A. | 5P + I56N + P157H |
| 1232 | A.A | 5P + I56N + P157H |
| 1233 | N.A. | 5P + L46Q + P157H |
| 1234 | A.A | 5P + L46Q + P157H |
| 1235 | N.A. | 5P + I59V |
| 1236 | A.A | 5P + I59V |
| 1237 | N.A. | 5P + A51T + E74K + P113L |
| 1238 | A.A | 5P + A51T + E74K + P113L |
| 1239 | N.A. | 5P + V36A |
| 1240 | A.A | 5P + V36A |
| 1241 | N.A. | 5P + A51T |
| 1242 | A.A | 5P + A51T |
| 1243 | N.A. | 5P + H57R |
| 1244 | A.A | 5P + H57R |
| 1245 | N.A. | 5P + V58A |
| 1246 | A.A | 5P + V58A |
| 1247 | N.A. | 5P + E74K |
| 1248 | A.A | 5P + E74K |
| 1249 | N.A. | 5P + H86Q |
| 1250 | A.A | 5P + H86Q |
| 1251 | N.A. | 5P + H93P |
| 1252 | A.A | 5P + H93P |
| 1253 | N.A. | 5P + I99V |
| 1254 | A.A | 5P + I99V |
| 1255 | N.A. | 5P + K123E |
| 1256 | A.A | 5P + K123E |
| 1257 | N.A. | 5P + T128S |
| 1258 | A.A | 5P + T128S |
| 1259 | N.A. | 5P + L142Q + T154N |
| 1260 | A.A | 5P + L142Q + T154N |
| 1261 | N.A. | 5P + H57Q |
| 1262 | A.A | 5P + H57Q |
| 1263 | N.A. | 5P + L92M |
| 1264 | A.A | 5P + L92M |
| 1265 | N.A. | 5P + P113L |
| 1266 | A.A | 5P + P113L |
| 1267 | N.A. | 5P + G48D |
| 1268 | A.A | 5P + G48D |

TABLE 2-continued

Polypeptide sequences

| SEQ ID NO | Polymer | ID |
|---|---|---|
| 1269 | N.A. | 5P-B9 (−147-157) |
| 1270 | A.A | 5P-B9 (−147-157) |
| 1271 | N.A. | 5P + L46R + P157S |
| 1272 | A.A | 5P + L46R + P157S |
| 1273 | N.A. | 5P + L46H + P157H |
| 1274 | A.A | 5P + L46H + P157H |
| 1275 | N.A. | 5P + L46R + H93P |
| 1276 | A.A | 5P + L46R + H93P |
| 1277 | N.A. | 5P + L46R + H93P + F31L |
| 1278 | A.A | 5P + L46R + H93P + F31L |
| 1279 | N.A. | 5P + L46R + H93P + K75E |
| 1280 | A.A | 5P + L46R + H93P + K75E |
| 1281 | N.A. | 5P + L46R + H93P + I76V |
| 1282 | A.A | 5P + L46R + H93P + I76V |
| 1283 | N.A. | 8S (5P + L46R + H93P + P157S + F31L) |
| 1284 | A.A | 8S (5P + L46R + H93P + P157S + F31L) |
| 1285 | N.A. | 5P + L46R + H93P + P157S + K75E |
| 1286 | A.A | 5P + L46R + H93P + P157S + K75E |
| 1287 | N.A. | 5P + L46R + H93P + P157S + I76V |
| 1288 | A.A | 5P + L46R + H93P + P157S + I76V |
| 1289 | N.A. | 12S (8S + A51T + K75E + I76V + I107L) |
| 1290 | A.A | 12S (8S + A51T + K75E + I76V + I107L) |
| 1291 | N.A. | 11S (12-A51T) |
| 1292 | A.A | 11S (12-A51T) |
| 1293 | N.A. | 12S-K75E |
| 1294 | A.A | 12S-K75E |
| 1295 | N.A. | 12S-I76V |
| 1296 | A.A | 12S-I76V |
| 1297 | N.A. | 12S-I107L |
| 1298 | A.A | 12S-I107L |

The polypeptides and coding nucleic acid sequences of Table 2 (SEQ ID NOS: 441-1298) all contain N-terminal Met residues (amino acids) or ATG start codons (nucleic acids). In some embodiments, the polypeptides and coding nucleic acid sequences of Table 2 are provided without N-terminal Met residues or ATG start codons (SEQ ID NOS: 1299-2156).

In certain embodiments, a polypeptide of one of the amino acid polymers of SEQ ID NOS: 441-2156 is provided. In some embodiments, polypeptides comprise a single amino acid difference from SEQ ID NO: 440. In some embodiments, polypeptides comprise two or more (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30 . . . 35 . . . 40 . . . 45 . . . 50, or more) amino acid differences from SEQ ID NO: 440 and/or any of the amino acid polymers of SEQ ID NOS: 441-2156. In some embodiments, polypeptides are provided comprising the sequence of one of the amino acid polymers of SEQ ID NOS: 441-2156 with one or more additions, substitutions, and/or deletions. In some embodiments, a polypeptide or a portion thereof comprises greater than 70% sequence identity (e.g., >71%, >75%, >80%, >85%, >90%, >91%, >92%, >93%, >94%, >95%, >96%, >97%, >98%, or >99%) with one or more of the amino acid polymers of SEQ ID NOS: 441-2156.

In certain embodiments, a nucleic acid from Table 2 is provided. In some embodiments, a nucleic acid encoding a polypeptide from Table 2 is provided. In some embodiments, a nucleic acid of the present invention codes for a polypeptide that comprises a single amino acid difference from SEQ ID NO: 440 and/or any of the amino acid polymers of SEQ ID NOS: 441-2156. In some embodiments, nucleic acids code for a polypeptide comprising two or more (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30 . . . 35 . . . 40 . . . 45 . . . 50, or more) amino acid differences from SEQ ID NO: 440 and/or any of the polypeptides listed in Table 2. In some embodiments, nucleic acids are provided comprising the sequence of one of the nucleic acid polymers of SEQ ID NOS: 441-2156. In some embodiments, nucleic acids are provided comprising the sequence of one of the nucleic acid polymers of SEQ ID NOS: 441-2156 with one or more additions, substitutions, and/or deletions. In some embodiments, a nucleic acid or a portion thereof comprises greater than 70% sequence identity (e.g., >71%, >75%, >80%, >85%, >90, >91%, >92%, >93%, >94%, >95%, >96%, >97%, >98%, or >99%) with one or more of the nucleic acid polymers of SEQ ID NOS: 441-2156. In some embodiments, a nucleic acid or a portion thereof codes for an polypeptide comprising greater than 70% sequence identity (e.g., >71%, >75%, >80%, >85%, >90%, >91%, >92%, >93%, >94%, >95%, >96%, >97%, >98%, or >99%) with one or more of the amino acid polymers of SEQ ID NOS: 441-2156. In some embodiments, nucleic acids are provided that code for one of the polypeptides of SEQ ID NOS: 441-2156. In some embodiments, nucleic acids are provided that code for one of the polypeptides of SEQ ID NOS: 441-2156 with one or more additions, substitutions, and/or deletions.

In some embodiments, a non-luminescent peptide or polypeptide and/or an interaction element, comprises a synthetic peptide, peptide containing one or more non-natural amino acids, peptide mimetic, conjugated synthetic peptide (e.g., conjugated to a functional group (e.g., fluorophore, luminescent substrate, etc.)).

The present invention provides compositions and methods that are useful in a variety of fields including basic research, medical research, molecular diagnostics, etc. Although the reagents and assays described herein are not limited to any particular applications, and any useful application should be viewed as being within the scope of the present invention, the following are exemplary assays, kits, fields, experimental set-ups, etc. that make use of the presently claimed invention.

Typical applications that make use of embodiments of the present invention involve the monitoring/detection of protein dimerization (e.g., heterodimers, homodimers), protein-protein interactions, protein-RNA interactions, protein-DNA interactions, nucleic acid hybridization, protein-small molecule interactions, or any other combinations of molecular entities. A first entity of interest is attached to a first member of a non-luminescent pair and the second entity of interest is attached to the second member of a non-luminescent pair. If a detectable signal is produced under the particular assay conditions, then interaction of the first and second entities are inferred. Such assays are useful for monitoring molecular interactions under any suitable conditions (e.g., in vitro, in vivo, in situ, whole animal, etc.), and find use in, for example, drug discovery, elucidating molecular pathways, studying equilibrium or kinetic aspects of complex assembly, high throughput screening, proximity sensor, etc.

In some embodiments, a non-luminescent pair of known characteristics (e.g., spectral characteristics, mutual affinity of pair) is used to elucidate the affinity of, or understand the interaction of, an interaction pair of interest. In other embodiments, a well-characterized interaction pair is used to determine the characteristics (e.g., spectral characteristics, mutual affinity of pair) of a non-luminescent pair.

Embodiments described herein may find use in drug screening and/or drug development. For example, the interaction of a small molecule drug or an entire library of small molecules with a target protein of interest (e.g., therapeutic target) is monitored under one or more relevant conditions (e.g., physiological conditions, disease conditions, etc.). In other embodiments, the ability of a small molecule drug or an entire library of small molecules to enhance or inhibit the interactions between two entities (e.g., receptor and ligand, protein-protein, etc.) is assayed. In some embodiments, drug screening applications are carried out in a high through-put format to allow for the detection of the binding of tens of thousands of different molecules to a target, or to test the effect of those molecules on the binding of other entities.

In some embodiments, the present invention provides the detection of molecular interactions in living organisms (e.g., bacteria, yeast, eukaryotes, mammals, primates, human, etc.) and/or cells. In some embodiments, fusion proteins comprising signal and interaction (target) polypeptides are co-expressed in the cell or whole organism, and signal is detected and correlated to the formation of the interaction complex. In some embodiments, cells are transiently and/or stably transformed or transfected with vector(s) coding for non-luminescent element(s), interaction element(s), fusion proteins (e.g., comprising a signal and interaction element), etc. In some embodiments, transgenic organisms are generated that code for the necessary fusion proteins for carrying out the assays described herein. In other embodiments, vectors are injected into whole organisms. In some embodiments, a transgenic animal or cell (e.g., expressing a fusion protein) is used to monitor the biodistribution of a small molecule or a biologic tethered (e.g., conjugated or genetically fused) to NLpeptide sequence that would form a complex in the subcellular compartments and/or tissues where it concentrates.

In some embodiments, a peptide (e.g., non-luminescent peptide) portion of a luminescent complex is employed as a protein tag (e.g., within cells). In such embodiments, a polypeptide (e.g., non-luminescent polypeptide) portion of a luminescent complex (e.g., capable of forming a luminescent complex with the non-luminescent peptide) is applied to cells (e.g., as part of a reagent) to detect/quantify the presence of proteins tagged with the non-luminescent peptide. For example, a protein of interest is fused to a high affinity NLpep (e.g., NLpep86). The NLpep is then transfected into cells of interest, a reagent containing NANO-GLO+NLpoly11S is then added to cells+media, and luminescence is detected. This assay scheme is demonstrated in FIG. 175. In some embodiments, the small size of the peptide is useful for protein tagging. In some embodiments, non-luminescent polypeptides used in such a system are stable enough to exist in a suitable buffer for extended periods of time (e.g., in the presence of the furimazine substrate). In certain embodiments, the non-luminescent polypeptide has minimal detectable luminescence in the absence of the complementing peptide (e.g., even in the presence of furimazine substrate). In some embodiments, optimized buffer conditions are utilized to meet criteria necessary for protein tagging. High affinity spontaneously polypeptides and peptides are useful in such systems, and have utility in, for example, immunoassays, detection of virus particles, the study of protein dynamics in living cells, etc. In some embodiments, such a system provides an extremely small protein tag (e.g., 11 amino acids) providing high sensitivity detection, stability (e.g., particularly under denaturing conditions), and/or a broad dynamic range.

The compositions and methods provided herein, as well as any techniques or technologies based thereon find use in a variety of applications and fields, a non-limiting list of example applications follows:

Antibody-free Western Blot: For example, a protein of interest is fused to a non-luminescent peptide (e.g., by genetic engineering) and expressed by any suitable means. The proteins separated (e.g., by PAGE) and transferred to a membrane. The membrane is then washed with complimentary non-luminescent polypeptide (e.g. allowing a luminescent complex to form), and placed on imager (e.g., utilizing a CCD camera) with Furimazine (PBI-3939) atop the membrane, and the protein of interest is detected (e.g., via the luminescence of the luminescent complex).

"LucCytochemistry": For example, a protein of interest is expressed fused to a non-luminescent peptide or polypeptide and then detected with a complimentary non-luminescent polypeptide or peptide in a fashion analogous to immunocytochemistry.

Protein localization assay: For example, a localization signal is added to a non-luminescent polypeptide or polypeptide (e.g., via genetic engineering) and expressed in cells (e.g., a nuclear localization signal added would result in expression of the non-luminescent polypeptide in the nucleus). A complimentary non-luminescent peptide or polypeptide is fused to a protein of interest (e.g., via genetic engineering) and expressed in cells with the non-luminescent polypeptide or peptide. Luminescence is produced if the protein of interest localizes in the same subcellular compartment (e.g., the nucleus) as the signal-localized non-luminescent polypeptide.

Protein Stability Assay: For example, a protein of interest is fused to a non-luminescent peptide or polypeptide (e.g., via genetic engineering) and incubated under one or more conditions of interest. A complimentary non-luminescent polypeptide or peptide is added (e.g., at various time points), and luminescence is used to quantify the amount of protein of interest (e.g., a proxy for stability).

Protein Detection/Quantification: For example, a protein of interest fused to a non-luminescent peptide or polypeptide (e.g., via genetic engineering) and expressed and/or manipulated by any method. The complimentary non-luminescent polypeptide or peptide is then added to detect and/or quantify the protein of interest.

Protein Purification: For example, a protein of interest is fused to a non-luminescent peptide or polypeptide (e.g., via genetic engineering) and expressed by any method. The mixture of proteins is passed through an immobilized complimentary non-luminescent polypeptide or peptide (e.g., on beads, on a column, on a chip, etc.), washed with suitable buffer and eluted (e.g., with a buffer of high ionic strength or low pH). A mutant form of the non-luminescent peptide or polypeptide that does not activate the luminescence of the complimentary non-luminescent peptide or polypeptide may be used to elute the protein of interest.

Pull-down: For example, an immobilized, complimentary, non-luminescent polypeptide is used to isolate a protein of interest (and interacting proteins) that is fused to a non-luminescent peptide (e.g., via genetic engineering).

G-Coupled Protein Receptor (GPCR) Internalization Assay: For example, a non-luminescent peptide or polypeptide is fused to a GPCR of interest (e.g., via genetic engineering) and expressed on the surface of cells. A complimentary non-luminescent polypeptide or peptide is added to the media of the cells and used to detect the GPCR on cell surface. A ligand is added to stimulate the internalization of the GPCR, and a decrease in luminescence is observed.

Membrane Integrity Assay for Cell Viability: For example, when the cell membrane of a cell expressing a non-luminescent polypeptide become compromised, a non-luminescent peptide enters the cell (e.g., a peptide that otherwise can't cross the cell membrane), thereby forming a luminescent complex, and generating luminescence.

5-Hydroxymethyl Cytosine Detection: For example, a cysteine is added to a non-luminescent peptide and incubated with DNA and a methyltransferase. The methyltransferase catalyzes the addition of the thiol (cysteine) only onto cytosine residues that are 5-hydroxymethylated. Unincorporated peptide is then separated from the DNA (using any method possible), and a non-luminescent polypeptide is added to detect the peptide conjugated to the DNA.

Formyl Cytosine Detection: For example, similar to the 5-hydroxymethyl cytosine detection above, this detection method uses chemistry with specific reactivity for formyl cytosine.

Viral Incorporation: Nucleic acid coding for a non-luminescent peptide or polypeptide is incorporated into a viral genome, and the complementary non-luminescent polypeptide or peptide is constitutively expressed in the target cells. Upon infection of the target cells and expression of the non-luminescent peptide, the bioluminescent complex forms and a signal is detected (e.g., in the presence of substrate).

Chemical Labeling of Proteins: A non-luminescent peptide is fused or tethered to a reactive group (e.g., biotin, succinimidyl ester, maleimide, etc.). A protein of interest (e.g., antibody) is tagged with the non-luminescent peptide through binding of the reactive group to the protein of interest. Because the peptide is small, it does not affect the functionality of the protein of interest. Complimentary non-luminescent polypeptide is added to the system, and a luminescent complex is produced upon binding to the polypeptide to the peptide.

Protease Assay: For example, a peptide sequence that is recognized by a protease of interest can be joined to NLPep in such a way that prevents bioluminescence upon exposure to NLPoly. Ways to do this include attaching a luminescence quencher to the protease recognition sequence or binding the protease recognition sequence to NLpep in such a way that complementation is hindered. Upon activity of the protease to cleave the recognition sequence, the ability of NLPoly to complement to NLPep and emit luminescence is restored, and thus the system is a sensitive protease assay.

RNA detection.

Biomolecule Linker characterization: For example, a linker attached to a biomolecule such as an antibody can be evaluated for its stability under a set of conditions through attaching NLPep to the molecule via the linker of interest. Over time, the production of free NLPep through linker degradation can be monitored by addition of NLPoly and furimazine and quantification of bioluminescence produced.

Mutation assay: For example, a point mutation, a frame-shift mutation, etc. introduced in vitro or in vivo results in either a gain of signal or loss of signal from a complementation pair. Such an assay could be used, for example, to test compounds for mutagenicity.

Target engagement for peptide inhibitors: Use of low affinity NLpep-conjugated peptides (expressed in cells) to monitor target engagement of peptide-based inhibitors. NLpoly is tethered to the target of interest. Engagement results in loss of signal from luminescent complex.

Gain of signal Protease biosensors: A protease cleavage site is expressed between NLpoly and a dark peptide NLpep (low affinity). Cleavage releases dark peptide allowing for high affinity NLpep to complement NLpoly.

Gain of function protease assay: The sequence of an NLpep is engineered proximal to a cleavage site of a full length substrate for a protease (e.g., caspase. ADAM, etc). The peptide remains sterically inaccessible as long as the substrate remains intact and the peptide is "buried". Both the genetically engineered protease substrate and a NLpoly (e.g., NLpoly11S) are co-transfected into a target cell line. Luciferase activity is induced upon induction of protease activity which leads to the cleavage of the substrate and exposure of the activator peptide on the N- or C-terminus of one of the fragments. This principle is expandable to detect conformational changes and/or protein modifications as well.

Intracellular analyte quantification using recombinant intrabodies: Antibody fragments expressed within cells as NLpoly or NLpep fusion. Complementary subunit is genetically fused to an analyte of interest. When analyte is present, antibody binds and luminescent complex is formed. The application is expandable to intracellular PTM (e.g. phosphonlation) biosensors, in which the intrabody only binds to the analyte when it has been phosphorylated (or otherwise bound by the modification-specific Ab).

The above applications of the compositions and methods of the present invention are not limiting and may be modified in any suitable manner while still being within the scope of the present invention.

The present invention also provides methods for the design and/or optimization of non-luminescent pairs/groups and the bioluminescent complexes that form therefrom. Any suitable method for the design of non-luminescent pairs/groups that are consistent with embodiments described herein, and/or panels thereof, is within the scope of the present invention.

In certain embodiments, non-luminescent pairs/groups are designed de novo to lack luminescence individually and exhibit luminescence upon association. In such embodiments, the strength of the interaction between the non-luminescent elements is insufficient to produce a bioluminescent signal in the absence of interaction elements to facilitate formation of the bioluminescent complex.

In other embodiments, non-luminescent elements and/or non-luminescent pairs are rationally designed, for example, using a bioluminescent protein (e.g., SEQ ID NO: 2157) as a starting point. For example, such methods may comprise: (a) aligning the sequences of three or more related proteins: (b) determining a consensus sequence for the related proteins; (c) providing first and second fragments of a bioluminescent protein that is related to the ones from which the consensus sequence was determined, wherein the fragments are individually substantially non-luminescent but exhibit luminescence upon interaction of the fragments: (d) mutating the first and second fragments at one or more positions each (e.g., in vitro, in silico, etc.), wherein said mutations alter the sequences of the fragments to be more similar to a corresponding portion of the consensus sequence, wherein the mutating results in a non-luminescent pair that are not fragments of a preexisting protein, and (e) testing the non-luminescent pair for the absence of luminescence when unassociated and luminescence upon association of the non-luminescent pair. In other embodiments, first and second fragments of one of the proteins used in determining the consensus sequence are provided, mutated, and tested.

In some embodiments, a peptide of a luminescent pair is a 'dark peptide,' or one that binds to its complement (e.g., NLpoly) (e.g., with low or high affinity) but produces minimal or no luminescence (See FIGS. 180-182). In some embodiments, a high affinity dark peptide finds use in inverse complementation, or gain of signal assays for measuring inhibitors. In some embodiments, a low affinity dark peptide is used to bring down background of NLpoly11S in a reagent for the detection of a high affinity peptide tag (e.g. NLpep86). Exemplary dark peptides are provided in FIG. 180.

In some embodiments, a peptide of a luminescent pair is a 'quencher peptide,' or one that contains a quencher moiety (e.g., DAB), and the quencher absorbs the light/energy produced by both a NLpoly in isolation (e.g., the signal produced independent of a complementing NLpep) and a NLpoly-NLpep complex (e.g., the signal produced as a result of complex formation). Exemplary dark quencher peptides would have a suitable absorption spectrum and include DAB-161 (DAB-GWRLFKK(SEQ ID NO: 2370)), DAB-162 (DAB-GWALFKK (SEQ ID NO: 2351)), DAB-163 (DAB-VTGWALFEEIL(SEQ ID NO: 2372)), DAB-164 (DAB-VTGYALFQEIL (SEQ ID NO: 2573)), DAB-165 (DAB-VTGYALFEQIL (SEQ ID NO: 2574), and DAB-166 (DAB-VTGYALFEEIL (SEQ ID NO: 2575); wherein DAB=Dabcyl (475 nm quencher)+dPEG4 spacer.

In some embodiments, the above methods are not limited to the design and/or optimization of non-luminescent pairs. The same steps are performed to produce pairs of elements that lack a given functionality (e.g., enzymatic activity) individually, but display such functionality when associated. In any of these cases, the strength of the interaction between the non-luminescent pair elements may be altered via mutations to ensure that it is insufficient to produce functionality in the absence of interaction elements that facilitate formation of the bioluminescent complex.

EXPERIMENTAL

Example 1

Generation of Peptides

Peptide constructs were generated by one of three methods: annealing 5'-phosphorylated oligonucleotides followed by ligation to pF4Ag-Bamase-HALOTAG vector (Promega Corporation; cut with SgfI and XhoI) or pFN18A (Promega Corporation: cut with SgfI and XbaI), site directed mutagenesis using Quik Change Lightning Multi kit from Agilent or outsourcing the cloning to Gene Dynamics.

Example 2

Peptide Preparation

The peptides generated in Example 1 were prepared for analysis by inoculating a single colony of KRX *E. coli* cells (Promega Corporation) transformed with a plasmid encoding a peptide into 2-5 ml of LB culture and grown at 37° C. overnight. The overnight cultures (10 ml) were then diluted into 1 L of LB and grown at 37° C. for 3 hours. The cultures were then induced by adding 10 ml 20% rhamnose to the 1 L culture and induced at 25° C. for 18 hours.

After induction, 800 ml of each culture was spun at 5000×g at 4° C. for 30 minutes. The pellet generated was then resuspended in 80 ml Peptide Lysis Buffer (25 mM HEPES pH 7.4, 0.1× Passive Lysis Buffer (Promega Corporation), 1 ml/ml lysozyme and 0.03 U/µl RQ1 DNase (Promega Corporation)) and incubated at room temperature for 15 minutes. The lysed cells were then frozen on dry ice for 15 minutes and then thawed in a room temperature bath for 15 minutes. The cells were then spun at 3500×g at 4° C. for 30 minutes. The supernatants were aliquoted into 10 ml samples with one aliquot of 50 µl placed into a 1.5 ml tube.

To the 50 µl samples, 450 µl $H_2O$ and 167 µl 4×SDS Loading Dye were added, and the samples incubated at 95° C. for 5 minutes. After heating, 5 µl of each sample was loaded (in triplicate) onto an SDS-PAGE gel, and the gel run and stained according to the manufacturer's protocol. The gel was then scanned on a Typhoon Scanner (excitation 532 nm, emission 580 nm, PMT sensitivity 400V). The resulting bands were quantified using the ImageQuant (5.2) software. Each of the three replicate intensities was averaged, and the average intensity of NLpep53-HT was defined at 12× concentration. The concentrations of all other peptides were relative to Pep53-HT.

Example 3

Peptide Analysis

All of the peptides generated in Examples 1-2 contained single mutations to the peptide sequence: GVTGWRL-CKRISA (SEQ ID NO: 236). All of the peptides were fused to a HALOTAG protein (Promega Corporation). Peptides identified as "HT-NLpep" indicate that the peptide is located at the C-terminus of the HALOTAG protein. In this case, the gene encoding the peptide includes a stop codon, but does not include a methionine to initiate translation. Peptides identified as "NLpep-HT" indicate that the peptide is at the N-terminus of the HALOTAG protein. In this case, the peptide does include a methionine to initiate translation, but does not include a stop codon.

To determine the ability of the peptides to activate luminescence, individual colonies of KRX *E. coli* cells (Promega Corporation) was transformed with a plasmid encoding a peptide from Example 1, inoculated in 200 µl of minimal medium (1×M9 salts, 0.1 mM $CaCl_2$, 2 mM $MgSO_4$, 1 mM Thiamine HCl, 1% gelatin, 0.2% glycerol, and 100 ul/ml Ampicillin) and grown at 37° C. overnight. In addition to the peptides, a culture of KRX *E. coli* cells expressing a wild-type (WT) fragment of residues 1-156 of the NANO- LUC was grown. All peptides and the WT fragment were inoculated into at least 3 separate cultures.

After the first overnight growth, 10 µl of culture was diluted into 190 µl fresh minimal medium and again grown at 37° C. overnight.

After the second overnight growth, 10µl of the culture was diluted into 190 µl of auto-induction medium (minimal medium+5% glucose and 2% rhamnose). The cultures were then induced at 25° C. for approximately 18 hours.

After induction, the small peptide mutant cultures were assayed for activity. The cultures containing the WT 1-156 fragment were pooled, mixed with 10 ml of 2× Lysis Buffer (50 mM HEPES pH 7.4, 0.3× Passive Lysis Buffer, and 1 mg/ml lysozyme) and incubated at room temperature for 10 minutes, 30 µl of the lysed WT 1-156 culture was then aliquoted into wells of a white, round bottom 96-well assay plate (Costar 3355). To wells of the assay plate, 20 µl of a peptide culture was added, and the plate incubated at room temperature for 10 minutes. After incubation, 50 µl NANO-GLO Luciferase Assay Reagent (Promega Corporation) was added, and the samples incubated at room temperature for 10 minutes. Luminescence was measured on a GLOMAX luminometer with 0.5 s integrations.

The results (See Table 3 and FIG. 1) demonstrate various mutations in the peptide (relative to SEQ ID NO: 1) that altered (e.g., increased, decreased) the luminescence following complementation with the wild-type non-luminescent polypeptide. The increased luminescence is thought to stem from one (or a combination) of five main factors, any of which are beneficial: affinity between the non-luminescent peptide and non-luminescent polypeptide, expression of the peptide, intracellular solubility, intracellular stability, and bioluminescent activity. The present invention though is not limited to any particular mechanism of action and an understanding of the mechanism of action is not necessary to practice the present invention.

TABLE 3

| Mutation | HT-NLPep | NLpep-HT | HT-Pep st. dev. | Pep-HT st. dev. |
| --- | --- | --- | --- | --- |
| G157D | 0.1137 | 0.5493 | N.D. | N.D. |
| G157N | 0.6415 | 3.3074 | 0.2512 | 1.4828 |
| G157S | 1.9937 | 1.7156 | 0.8554 | 1.0563 |
| G157E | 0.1959 | 1.4461 | 0.0811 | 0.3221 |
| G157H | 0.9380 | 0.5733 | 0.4366 | 0.2277 |
| G157C | N.D. | 0.0468 | N.D. | 0.0081 |
| G157P | N.D. | 0.0543 | N.D. | 0.0106 |
| V158I | 0.6075 | 1.6010 | 0.3283 | 0.6264 |
| V158A | 0.1348 | 0.1438 | 0.0561 | 0.0447 |
| V158K | 0.0770 | 0.1923 | 0.0323 | 0.0521 |
| V158Q | 0.0445 | 0.0397 | 0.0188 | 0.0160 |
| V158S | 0.0487 | 0.0838 | 0.0189 | 0.0251 |
| T159V | 0.5658 | 0.0455 | 0.2293 | 0.0005 |
| T159K | 0.0490 | 0.0307 | 0.0120 | 0.0103 |
| T159Q | 0.3979 | 0.0310 | 0.1063 | 0.0091 |
| W161T | 0.0028 | 0.0100 | 0.0007 | 0.0049 |
| W161K | 0.0002 | 0.0008 | 9.7E−06 | 0.0001 |
| W161V | 0.0086 | 0.0050 | 0.0062 | 0.0016 |
| W161F | N.D. | 0.0717 | N.D. | 0.0049 |
| W161Y | N.D. | 0.2154 | N.D. | 0.0103 |
| W161E | N.D. | 0.0012 | N.D. | 0.0002 |
| L163I | N.D. | 0.2923 | N.D. | 0.1198 |
| L163V | 0.1727 | 0.1190 | 0.0257 | 0.0288 |
| L163T | 0.0259 | 0.0262 | 0.0077 | 0.0122 |
| L163Y | 0.0512 | 0.1959 | 0.0126 | 0.1043 |
| L163K | 0.0885 | 0.0786 | 0.0130 | 0.0244 |
| C164N | 0.0874 | 0.1081 | 0.0097 | 0.0160 |
| C164T | 0.0116 | 0.0084 | 0.0029 | 0.0013 |
| C164F | N.D. | 13.3131 | N.D. | 3.6429 |
| C164Y | N.D. | 1.0092 | N.D. | 0.2592 |
| C164S | N.D. | 0.0202 | N.D. | 0.0029 |
| C164H | N.D. | 0.7597 | N.D. | 0.2149 |

TABLE 3-continued

| Mutation | HT-NLPep | NLpep-HT | HT-Pep st. dev. | Pep-HT st. dev. |
| --- | --- | --- | --- | --- |
| C164M | N.D. | 3.2618 | N.D. | 1.1763 |
| C164A | N.D. | 0.0858 | N.D. | 0.0196 |
| C164Q | N.D. | 0.0211 | N.D. | 0.0044 |
| C164L | N.D. | 1.0170 | N.D. | 0.2464 |
| C164K | N.D. | 0.0005 | N.D. | 0.0001 |
| R166K | 1.0910 | 1.2069 | 0.2266 | 0.5913 |
| R166N | 0.1033 | 0.1182 | 0.0289 | 0.0542 |
| I167V | 0.8770 | 1.0824 | 0.1113 | 0.2642 |
| I167Q | 0.0178 | 0.1172 | 0.0252 | 0.0150 |
| I167E | 0.2771 | 0.2445 | 0.0358 | 0.0456 |
| I167R | 0.0464 | 0.0469 | 0.0027 | 0.0084 |
| I167F | 0.2832 | 0.1793 | 0.0159 | 0.0683 |
| A169N | 0.9115 | 1.7775 | 0.1114 | 0.5901 |
| A169T | 0.9448 | 1.3720 | 0.0930 | 0.6021 |
| A169R | 0.9851 | 0.5014 | 0.2205 | 0.1895 |
| A169L | 1.1127 | 0.9047 | 0.1906 | 0.2481 |
| A169E | 0.8457 | 0.7889 | 0.1445 | 0.0819 |

Example 4

Generation of Non-Luminescent Polypeptides

Using pF4Ag-NANOLUC 1-156 (WT 1-156) as a template, error-prone PCR (epPCR) was performed using the Diversify PCR Random Mutagenesis Kit from Clontech. The resulting PCR product was digested with SgfI and XbaI and ligated to pF4Ag-Barnase (Promega Corporation), a version of the commercially-available pF4A vector (Promega) which contains T7 and CMV promoters and was modified to contain an *E. coli* ribosome-binding site. Following transformation into KRX *E. coli* cells (Promega Corporation) by heat shock at 42° C., individual colonies were used to inoculate 200 µl cultures in clear, flat bottom 96-well plates (Costar 3370).

Example 5

Non-Luminescent Polypeptide Analysis

To determine the luminescence of the non-luminescent polypeptide mutants generated in Example 4, individual colonies of the KRX *E. coli* cells (Promega Corporation) transformed with a plasmid containing one of the non-luminescent polypeptide mutants from Example 4 was grown according to the procedure used in Example 3. The bacterial cultures were also induced according to the procedure used in Example 3.

To assay each non-luminescent polypeptide mutant induced culture, 30 µl of assay lysis buffer (25 mM HEPES pH 7.4, 0.3× Passive Lysis Buffer (Promega Corporation)), 0.006 U/µl RQ1 DNase (Promega Corporation) and 1× Peptide Solution (the relative concentration of the peptides were determined as explained in Example 2; from the relative concentration determined, the peptides were diluted to 1× in the lysis buffer) containing either the peptide fragment GVTGWRLCKRISA (SEQ ID NO: 18) or GVT-GWRLFKRISA (SEQ ID NO: 106) were aliquoted into wells of a 96-well assay plate (Costar 3355). To the wells of the assay plate, 20 µl of an induced non-luminescent polypeptide mutant culture was added, and the plate incubated at room temperature for 10 minutes. After incubation, 50 µl of NANOGLO Luciferase Assay Reagent (Promega Corporation) was added, and the samples incubated at room temperature for 10 minutes. Luminescence was measured on a GLOMAX luminometer with 0.5 s integrations.

The results (Table 4 and FIG. 2) demonstrate numerous point mutations that improve the luminescence of the non-luminescent polypeptide upon complementation with two different peptides. Similar to the mutations in the peptide, these mutations in the non-luminescent polypeptide may stem from various factors, all of which are beneficial to the system as a whole.

TABLE 4

| Mutation | V157D | F31I | L18Q | R11N |
|---|---|---|---|---|
| GVTGWRLCKRISA | 4.98 | 4.1 | 3.81 | 3.37 |
| st dev | 0.48 | 0.37 | 0.29 | 0.67 |
| GVTGWRLFKRISA | 3.02 | 2.83 | 2.99 | 2.09 |
| st dev | 0.77 | 0.61 | 0.82 | 0.03 |

| Mutation | Q32R | M106V | M106I | G67S |
|---|---|---|---|---|
| GVTGWRLCKRISA | 1.52 | 1.3 | 1.27 | 1.22 |
| st dev | 0.2 | 0.22 | 0.04 | 0.26 |
| GVTGWRLFKRISA | 1.04 | 1.4 | 1.31 | 1.29 |
| st dev | 0.19 | 0.25 | 0.35 | 0.22 |

| Mutation | F31L | L149M | N33K | I59T |
|---|---|---|---|---|
| GVTGWRLCKRISA | 3.13 | 2.89 | 2.15 | 1.07 |
| st dev | 0.26 | 0.39 | 0.2 | 0.07 |
| GVTGWRLFKRISA | 2.86 | 2.16 | 1.76 | 1.35 |
| st dev | 0.7 | 0.26 | 0.08 | 0.37 |

| Mutation | I56N | T13I | F31V | N33R |
|---|---|---|---|---|
| GVTGWRLCKRISA | 0.44 | 2.18 | 2.12 | 2.1 |
| st dev | 0.05 | 0.75 | 0.09 | 0.18 |
| GVTGWRLFKRISA | 1.81 | 1.44 | 2.12 | 1.56 |
| st dev | 0.35 | 0.34 | 0.46 | 0.16 |

| Mutation | V27M | Q20K | V58A | K75E |
|---|---|---|---|---|
| GVTGWRLCKRISA | 1.99 | 4.43 | 1.88 | 2.08 |
| st dev | 0.09 | 0.84 | 0.6 | 0.47 |
| GVTGWRLFKRISA | 1.7 | 2.33 | 1.07 | 2.05 |
| st dev | 0.11 | 0.38 | 0.26 | 0.37 |

| Mutation | G15S | G67D | R112N | N156D |
|---|---|---|---|---|
| GVTGWRLCKRISA | 1.98 | 1.78 | 1.61 | 1.57 |
| st dev | 0.99 | 0.11 | 0.2 | 0.21 |
| GVTGWRLFKRISA | 2.34 | 1.57 | 1.45 | 1.21 |
| st dev | 0.82 | 0.17 | 0.47 | 0.26 |

| Mutation | D108N | N144T | N156S |
|---|---|---|---|
| GVTGWRLCKRISA | 2.08 | 3.69 | 1.04 |
| st dev | 0.6 | 1.12 | 0.29 |
| GVTGWRLFKRISA | 1.88 | 2.26 | 1.4 |
| st dev | 0.38 | 0.51 | 0.28 |

*Units in Table 4 are RLU(mutant)/RLU(WT)

Example 6

Glycine to Alanine Substitutions in Non-Luminescent Polypeptide

Figure 2:
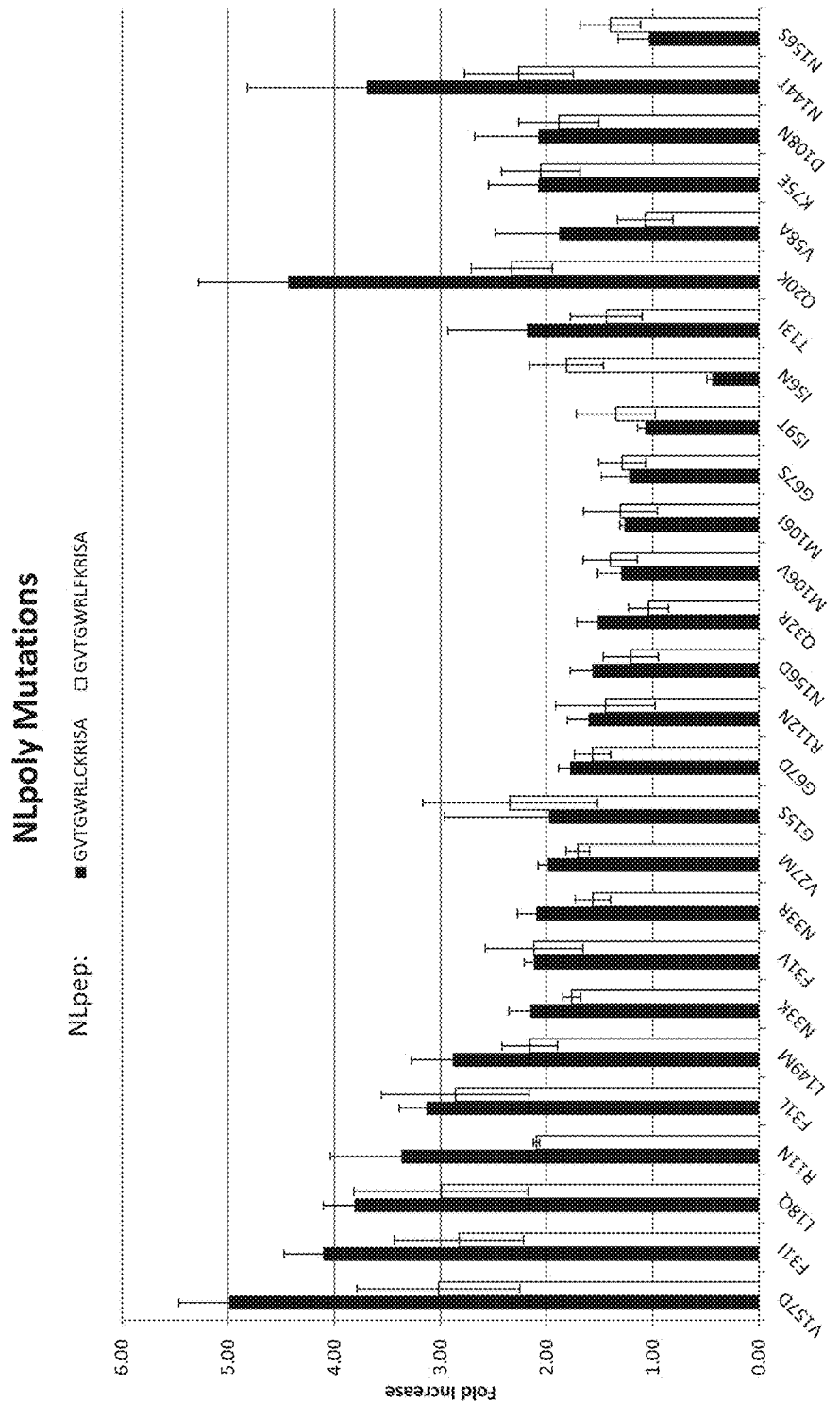
FIG. 2 shows a graph depicting the effect of various mutations of the SEQ ID NO: 440 polypeptide on luminescence resulting from complementation with GVTGWRLCKRISA (SEQ ID NO: 236) or GVTGWRLFKRISA (SEQ ID NO: 108) peptides.

The following example identified glycine residues within the non-luminescent polypeptide that can be substituted to alanine to provide an improved (e.g., greater luminescent signal) non-luminescent polypeptide. The substitutions were made singly (See FIG. 3), or in composites (FIG. 2). Non-luminescent polypeptides containing glycine to alanine substitutions were generated as described in Example 1.

Each single mutant colony was inoculated in 200 μl Minimal Media (1×M9 salts, 0.1 mM CaCl$_2$, 2 mM MgSO$_4$, 1 mM Thiamine HCl, 1% gelatin, 0.2% glycerol and 1× ampicillin) and incubated with shaking at 37° C. for 20 hours. 10 μl of the culture was then added to 190 μl of fresh Minimal Media and incubated again with shaking at 37° C. for 20 hours. 10 μl of the second culture was then added to 190 μl Auto-Induction Media (Minimal Media+5% glucose+2% rhamnose) and incubated with shaking at 25° C. for 18 hours to allow expression of the non-luminescent polypeptide.

To assay each mutant culture, 30 μl of assay lysis buffer (50 mM HEPES pH 7.5, 0.3× Passive Lysis Buffer (Promega Corporation)) and 0.006 U/μl RQ1 DNase (Promega Corporation)) containing non-luminescent peptide (1:10 dilution of NLpep9-HT (NLpep9 is SEQ ID NO: 17 and 18; HT is HALOTAG E. coli clarified lysate) was added. The samples were shaken at room temperature for 10 minutes, and then 50 μl NANOGLO Luciferase Assay Reagent (Promega Corporation) was added. The samples were incubated at room temperature for 10 minutes, and luminescence was measured on a GLOMAX luminometer with 0.5 s integrations.

To generate the NLpep9-HT E. coli clarified lysate, 5 ml LB was inoculated with a single E. coli colony of NLpep9-HT and incubated at 37° C. overnight. 500 μl of the overnight culture was then diluted in 50 mls LB and incubated at 37° C. for 3 hours. 500 μl of 20% rhamnose was added and incubated at 25° C. for 18 hours. The expression culture was centrifuged at 3000×g for 30 minutes, and the cell pellet resuspended in 5 ml peptide lysis buffer (25 mM HEPES, pH 7.5, 0.1× Passive Lysis Buffer, 1 mg/ml lysozme, and 0.3 U/l RQ1 DNase) and incubated at room temperature for 10 minutes. The lysed sample was placed on dry ice for 15 minutes, thawed in a room temperature water bath and centrifuged at 3500×g for 30 minutes. The supernatant was the clarified lysate.

Figure 3:
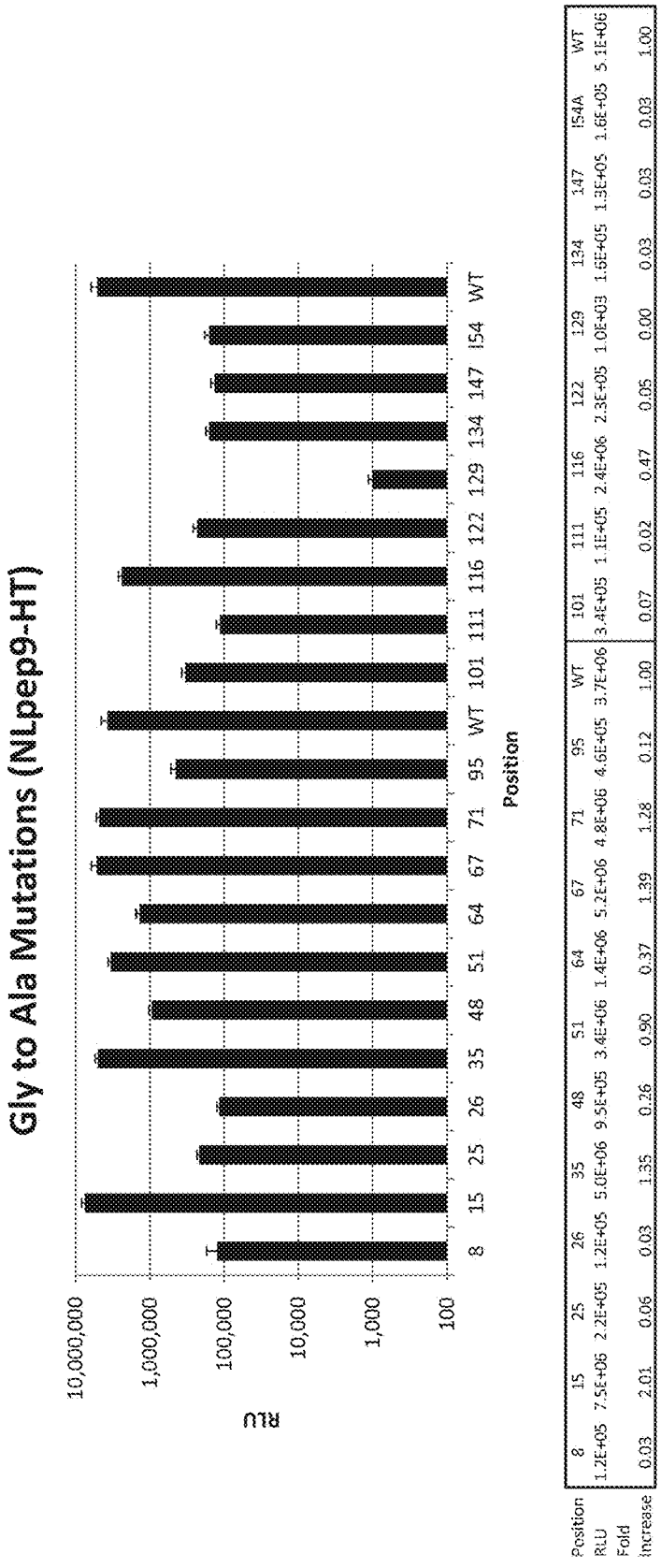
FIG. 3 (top) shows the luminescence (RLUs) detected in each non-luminescent polypeptide (NLpoly) mutant containing a single glycine to alanine substitution and (bottom) shows the fold increase in luminescence over wild-type.
Figure 4:
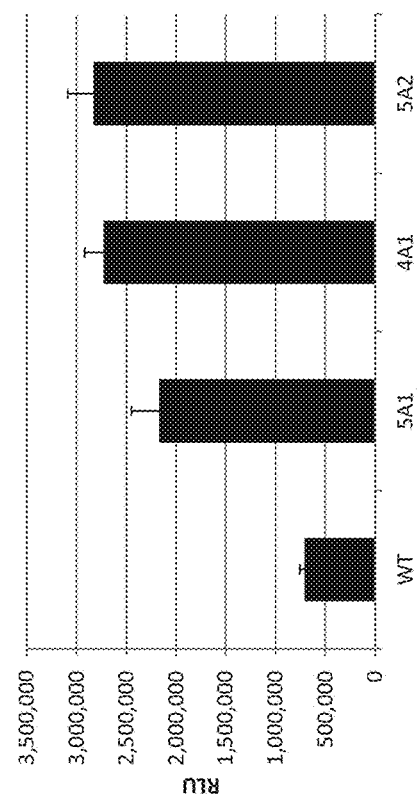
FIG. 4 (top) show the luminescence (RLUs) detected in each NLpoly mutant containing a composite of glycine to alanine substitutions and (bottom) shows the fold increase in luminescence over wild-type.

FIGS. 3 and 4 demonstrate the effects of the mutations on luminescence.

Example 7

Mutations in Non-Luminescent Peptide

In the following example, mutations were made in the non-luminescent peptide based on alignment to other fatty acid binding proteins (FABPs) and were chosen based on high probability (frequency in FABPs) to identify a mutation that retains/improves activity (such as NLpep2, 4, and 5) or establish that a mutation is not likely to be tolerated at that position (such as NLpep3). NLpep1-5 contain single mutations (See Table 1), and NLpep6-9 are composite sets of the mutations in NLpep2, 4, and 5 (See Table 1). Mutants were generated as described in Example 1.

Each mutant colony was inoculated in 200 μl Minimal Media and incubated with shaking at 37° C. for 20 hours. 10 μl of the culture was then added to 190 μl of fresh Minimal Media and incubated again with shaking at 37° C. for 20 hours. 10 μl of the second culture was then added to 190 μl Auto-Induction Media and incubated with shaking at 25° C. for 18 hours to allow expression of the non-luminescent peptide mutant.

To assay each mutant culture, 30 μl of assay lysis buffer (50 mM HEPES pH 7.5, 0.3× Passive Lysis Buffer (Promega Corporation)) and 0.006 U/μl RQ1 DNase (Promega Corporation)) containing non-luminescent polypeptide (1:10 dilution of wild-type non-luminescent polypeptide E. coli clarified lysate) was added. The samples were shaken at room temperature for 10 minutes, and then 50 μl NANO-GLO Luciferase Assay Reagent (Promega Corporation)

added. The samples were incubated at room temperature for 10 minutes, and luminescence was measured on a GLOMAX luminometer with 0.5 s integrations.

Figure 1:
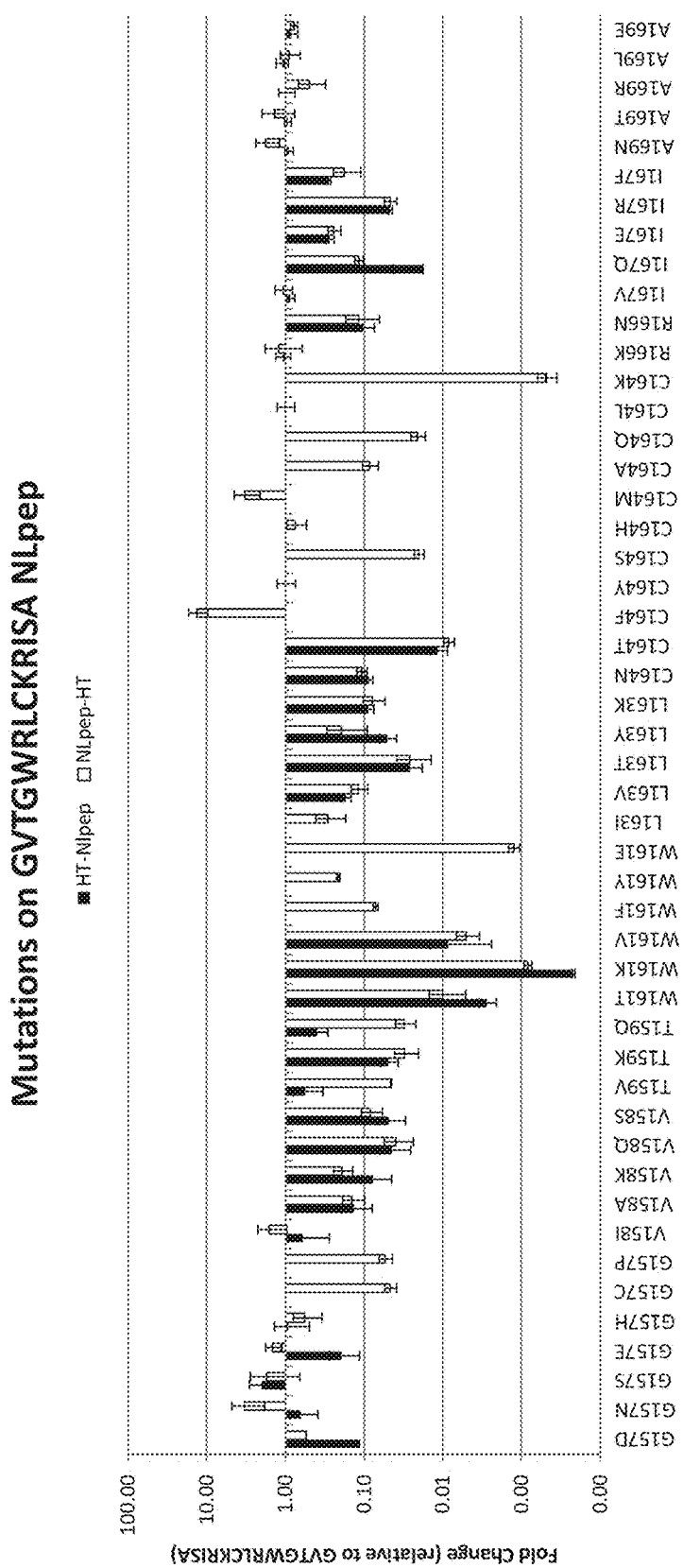
FIG. 1 shows a graph depicting the effect of various mutations of the GVTGWRLCKRISA (SEQ ID NO: 236) peptide on luminescence resulting from complementation with SEQ ID NO: 440.

FIG. 1 shows the luminescence (RLUs) detected in each non-luminescent peptide mutant. The results demonstrate various positions that are able to tolerate a mutation without substantial loss in luminescence, as well as a few specific mutations that improve luminescence.

Example 8

Effect of Orientation of Fusion Tag on Luminescence

In the following example, luminescence generated by non-luminescent peptides with N- or C-terminus HALOTAG protein was compared.

Figure 6:
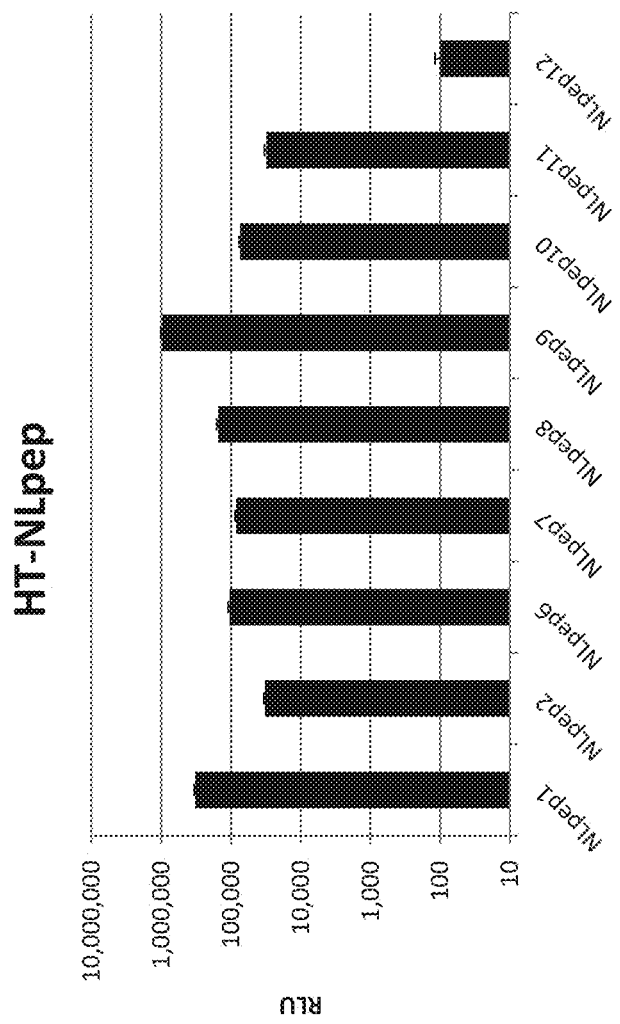
FIG. 6 shows a graph depicting the luminescence (RLUs) detected in HT-NLpep fusions.
Figure 7:
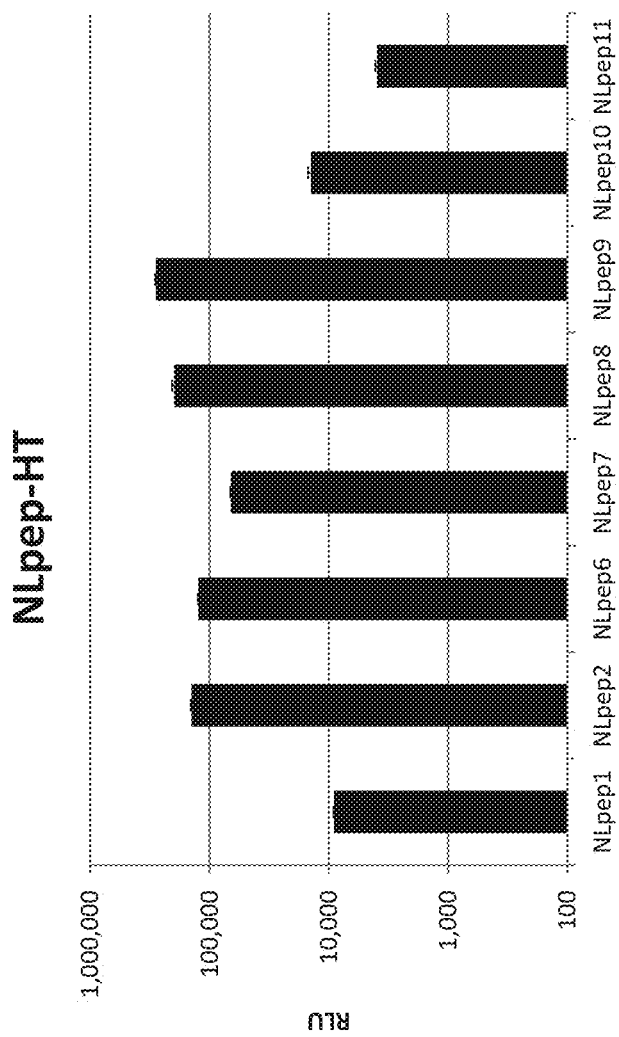
FIG. 7 shows a graph depicting the luminescence (RLUs) detected in NLpeptide-HT fusions.

Single colony of each peptide-HT fusion was grown according to the procedure used in Example 7. The bacterial cultures were also induced according to the procedure used in Example 7. Luminescence was assayed and detected according to the procedure used in Example 7. FIGS. 6 and 7 demonstrate the luminescence (RLUs) detected in each peptide-HT fusion. The results demonstrate combinations of mutations that produce similar luminescence as NLpep1.

Example 9

Effect of Multiple Freeze-Thaw Cycles on Non-Luminescent Peptides 1 ml of NLpep9-HT was frozen on dry ice for 5 minutes and then thawed in a room temperature water bath for 5 minutes. 60 µl was then removed for assaying. The freeze-thaw procedure was then repeated another 10 times. After each freeze-thaw cycle, 60 µl of sample was removed for assaying.

Figure 8:
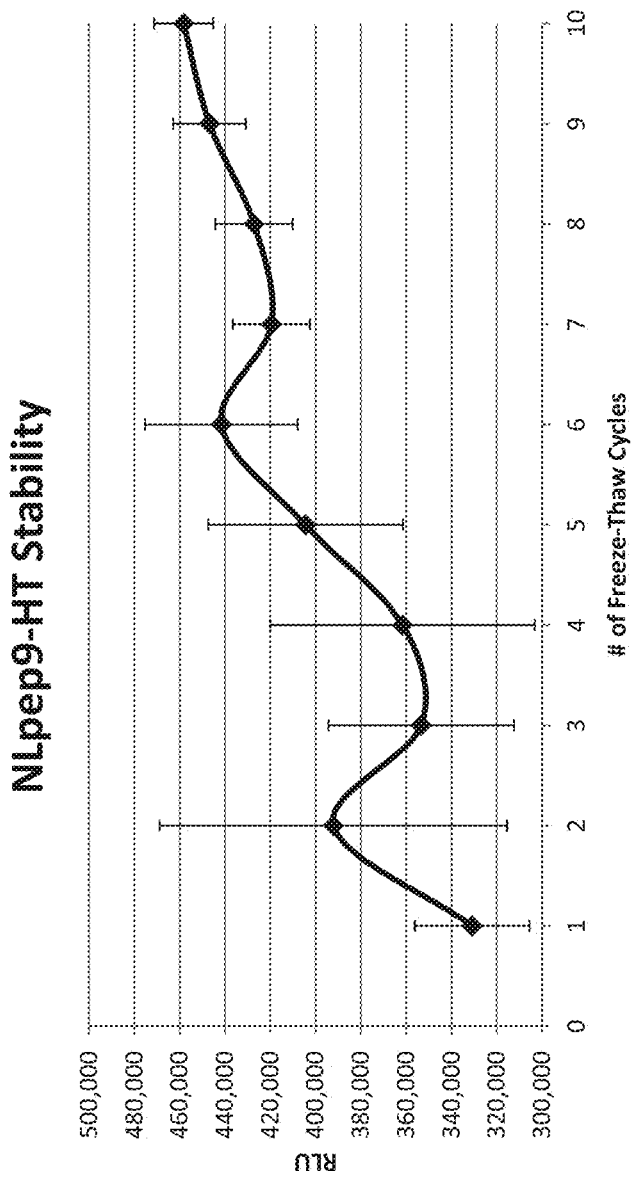
FIG. 8 shows the luminescence (RLUs) generated by a luminescent complex after freeze-thaw cycles of non-luminescent peptide (NLpep).

To assay, 20 µl of each freeze-thaw sample was mixed with 30p of SEQ ID NO:2 and incubated at room temperature for 10 minutes. 50 µl of NANOGLO Luciferase Assay Reagent was added, and the samples incubated at room temperature for 10 minutes. Luminescence was measured on a GLOMAX luminometer with 0.5 s integrations. The results are depicted in FIG. 8 and demonstrate that NLpep can be subjected to multiple freeze-thaw cycles without a loss in activity (luminescence).

Example 10

Distinction of Mutations in Non-Luminescent Peptides

In the following example, TMR gel analysis was used to normalize the concentration of the non-luminescent peptide mutants to distinguish mutations that alter the expression from those that alter luminescence (e.g., altered luminescence may stem from altered binding affinity).

5 ml of LB was inoculated with a single mutant peptide colony and incubated with shaking at 37° C. for 20 hours. 50 µl of the overnight culture was diluted into 5 ml of fresh LB and incubated with shaking at 37° C. for 3 hours. 50 µl of 20% rhamnose was then added and incubated with shaking at 25° C. for 18 hours.

For TMR gel analysis, 79 µl of each induced culture was mixed with 10 µl 10× Fast Break Lysis Buffer (Promega Corporation), 10 µl of a 1:100 dilution of HALOTAG TMR ligand (Promega Corporation) non-luminescent polypeptide and 10 µl of RQ1 DNase and incubated at room temperature for 10 minutes. 33.3 µl of 4×SDS-loading buffer was added, and the samples incubated at 95° C. for 5 minutes. 15 µl of each sample was loaded onto an SDS gel and run according to the manufacturer's directions. The gel was then scanned on a Typhoon.

Figure 9:
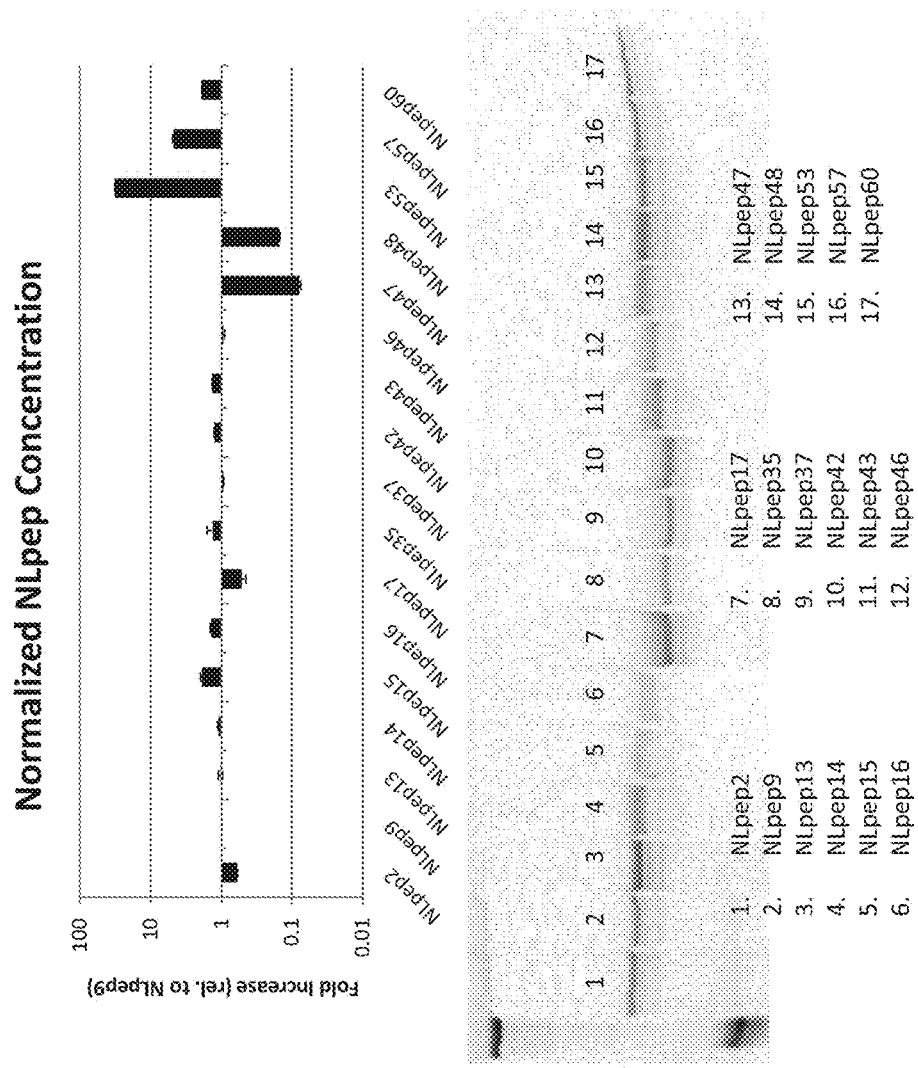
FIG. 9 shows concentration normalized activity of peptides, and the TMR gel used to determine the relative concentrations.
Figure 11:
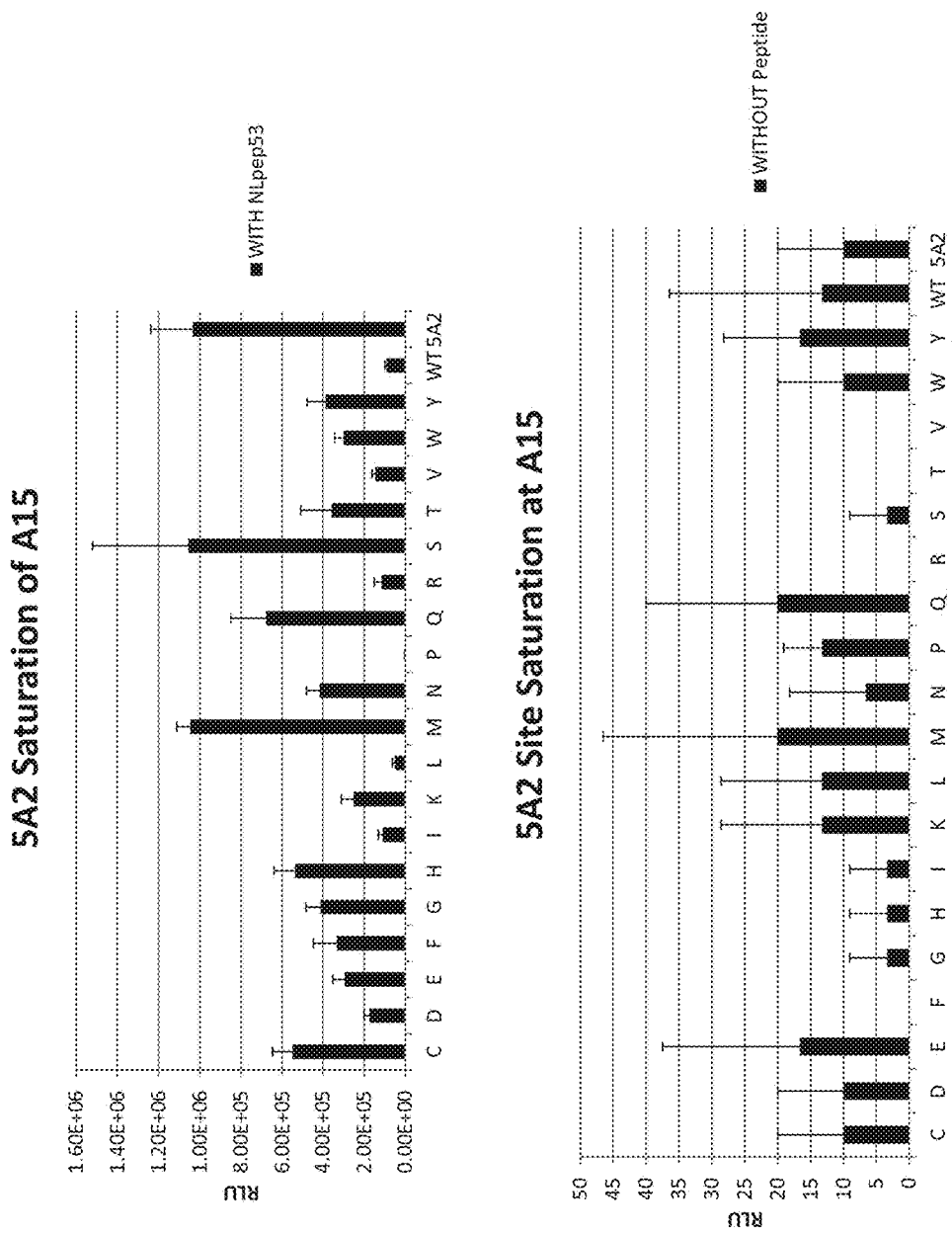
FIG. 11 shows a graph of the luminescence of various mutations of residue A15 of NLpoly 5A2 in the presence of NLpep53 (top) and in the absence of complimentary peptide (bottom).
Figure 12:
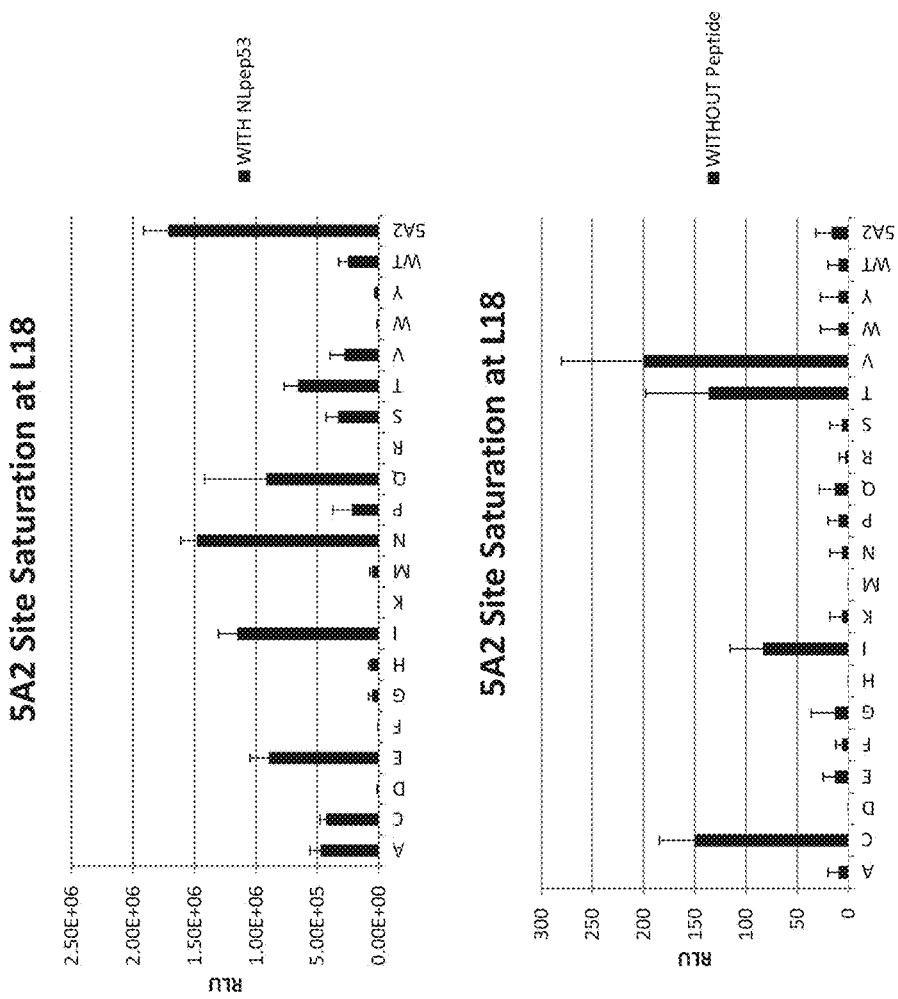
FIG. 12 shows a graph of the luminescence of various mutations of residue L18 of NLpoly 5A2 in the presence of NLpep53 (top) and in the absence of complimentary peptide (bottom).
Figure 14:
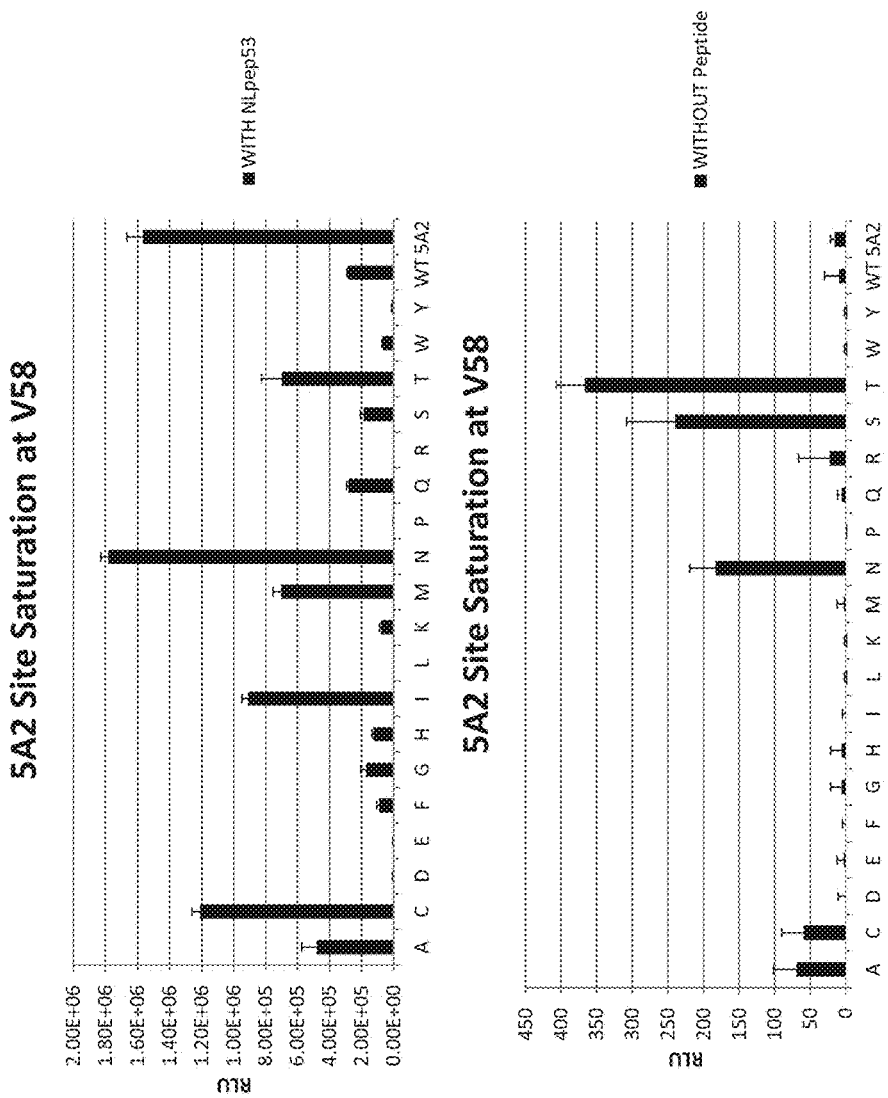
FIG. 14 shows a graph of the luminescence of various mutations of residue V58 of NLpoly 5A2 in the presence of NLpep53 (top) and in the absence of complimentary peptide (bottom).

Each culture was diluted based on the TMR-gel intensity to normalize concentrations. 20 µl of each diluted culture was then mixed with 30 µl assay lysis buffer containing non-luminescent polypeptide (1:10 dilution of SEQ ID NO: 2 E. coli clarified lysate) and incubated with shaking at room temperature for 10 minutes. 50 µl of NANOGLO Luciferase Assay Reagent was added, and the samples incubated at room temperature for 10 minutes. Luminescence was measured on a GLOMAX luminometer with 0.5 s integrations (SEE FIG. 9).

Example 11

Site Saturation in Non-Luminescent Polypeptide

In the following example, positions 11, 15, 18, 31, 58, 67, 106, 149, and 157 were identified as sites of interest from screening the library of random mutations in wild-type non-luminescent polypeptide. All 20 amino acids at these positions (built on 5A2 non-luminescent mutant generated in Example 6 (SEQ ID NOS: 539 and 540) to validate with other mutations in the 5A2 mutant) were compared to determine the optimal amino acid at that position. Mutant non-luminescent polypeptides were generated as previously described in Example 1. Single colony of each non-luminescent polypeptide mutant was grown according to the procedure used in Example 6. The bacterial cultures were also induced according to the procedure used in Example 6. Luminescence was assayed and detected according to the procedure used in Example 6 expect NLpep53 E. coli clarified lysate was used at 1:11.85 dilution.

FIGS. 10-18 demonstrate the effect of the mutations on the ability to produce luminescence with and without NLpep.

Example 12

Comparison of Cysteine Vs. Proline as First Amino Acid in Non-Luminescent Peptide In the following example, a comparison of using cysteine or proline as first amino acid (after necessary methionine) in the non-luminescent peptide was performed. The mutant non-luminescent peptides were generated as previously described in Example 1. Single colony of each non-luminescent polypeptide mutant was grown according to the procedure used in Example 7. The bacterial cultures were also induced according to the procedure used in Example 7. Luminescence was assayed and detected according to the procedure used in Example 7.

Figure 19:
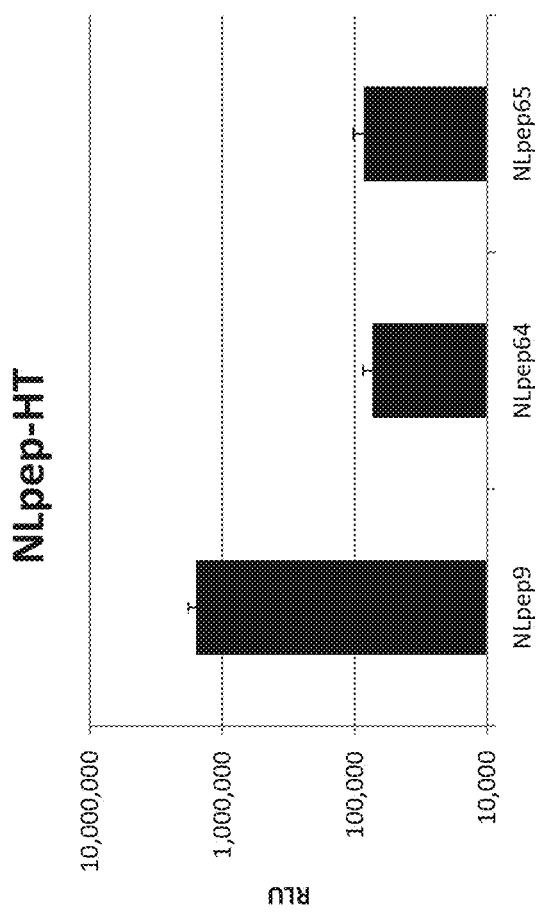
FIG. 19 shows a graph of the luminescence of NLpep-HT fusions.

FIG. 19 demonstrates that both cysteine and proline can be used as the first amino acid of NLpep and produce luminescence.

Example 13

Identification of the Optimal Composite Set of Mutations for the Non-Luminescent Peptide In the following examples, an optimal composite set(s) of mutations for the non-luminescent peptide were identified.

The mutant non-luminescent peptides were generated as previously described in Example 1.

Figure 20:
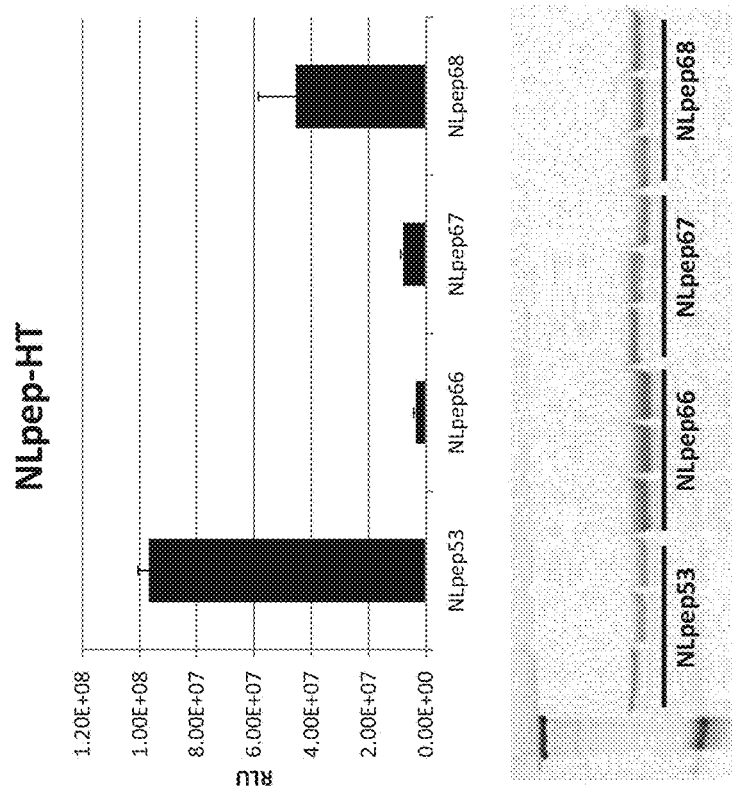
FIG. 20 shows a graph of the luminescence of NLpep-HT fusions, and a TMR gel indicating their relative expression levels.
Figure 21:
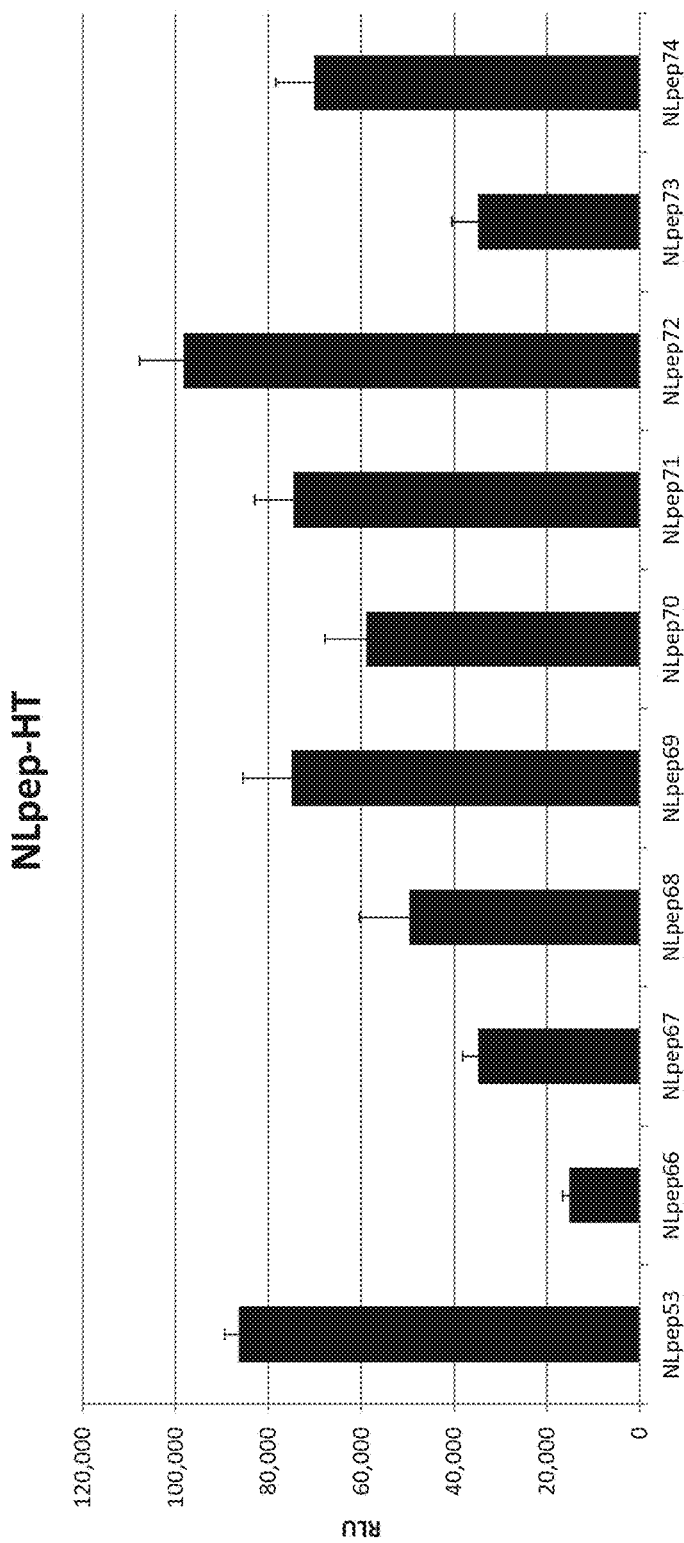
FIG. 21 shows a graph of the luminescence of NLpep-HT fusions.

1) For non-luminescent peptide composite mutants NLpep53, NLpep66, NLpep67, and NLpep68, a single colony of each was grown according to the procedure used in Example 10. The bacterial cultures were also induced according to the procedure used in Example 10. TMR gel analysis and luminescence was assayed and detected according to the procedure used in Example 10. The results in FIG. 20 demonstrate the luminescence as well as the *E. coli* expression of NLpeps containing multiple mutations. 2) For non-luminescent peptide composite mutants NLpep53 and NLpeps 66-74, a single colony of each was grown according to the procedure used in Example 7. The bacterial cultures were also induced according to the procedure used in Example 7. Luminescence was assayed and detected according to the procedure used in Example 7. The results in FIG. 21 demonstrate the luminescence of NLpeps containing multiple mutations.

Figure 22:
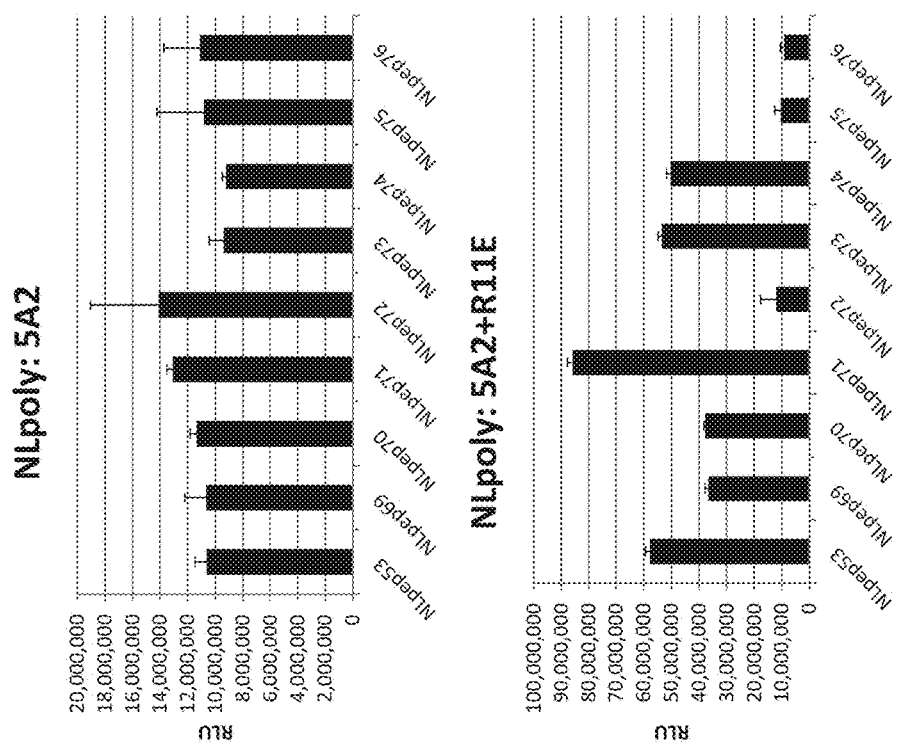
FIG. 22 shows a graph of the luminescence of NLpoly 5A2 (top) and NLpoly5A2+R11E in the presence of various NLpeps (bottom).

3) For non-luminescent peptide composite mutants NLpep53 and NLpeps 66-76, a single colony of each was grown according to the procedure used in Example 7. The bacterial cultures were also induced according to the procedure used in Example 7. Luminescence was assayed and detected according to the procedure used in Example 7 except the non-luminescent polypeptide was 5A2 or 5A2+R11E (1:10 dilution of *E. coli* clarified lysate). The results in FIG. 22 demonstrate the luminescence of NLpeps containing multiple mutations with 5A2 or 5A2+R11E. These results also demonstrate the lower luminescence when the NLpoly mutation R11E is complemented with an NLpep containing E as the 9th residue (NLpep72, 75, and 76).

Figure 23:
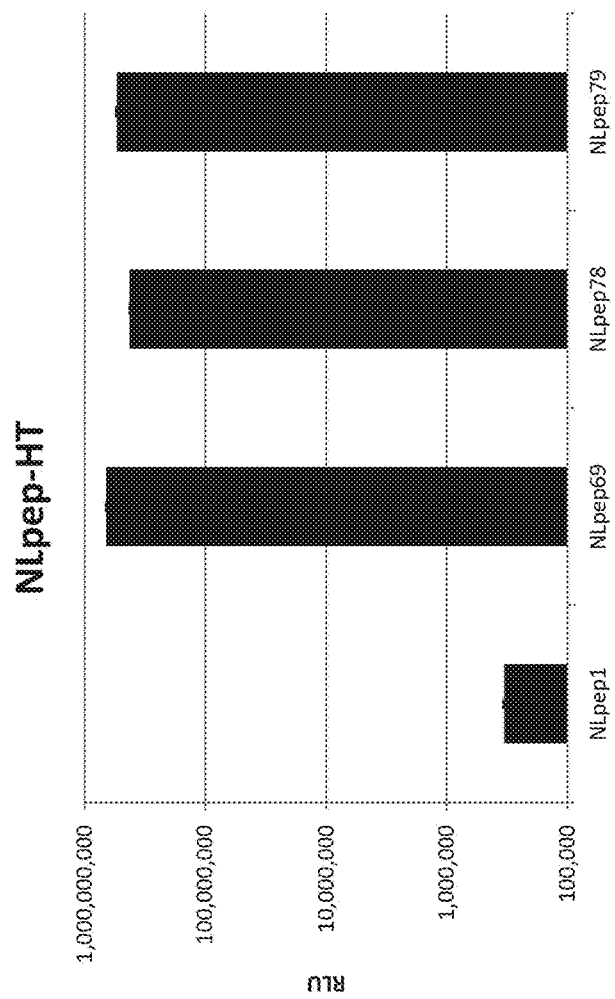
FIG. 23 shows a graph of the luminescence of NLpep-HT fusions.

4) For non-luminescent peptide composite mutants NLpep1, NLpep69, NLpep78 and NLpep79, a single colony of each was grown according to the procedure used in Example 7. The bacterial cultures were also induced according to the procedure used in Example 7. Luminescence was assayed and detected according to the procedure used in Example 7 except the non-luminescent polypeptide was WT (1:10 dilution of *E. coli* clarified lysate). The results in FIG. 23 demonstrate the luminescence of NLpeps containing multiple mutations.

Example 14

Composite Non-Luminescent Polypeptide Mutants

In the following example, 9 mutations from the library screens were combined into a composite clone (NLpoly 1, SEQ ID NOS: 941,942), and then one of the mutations reverted back to the original amino acid (NLpoly2-10, SEQ ID NOS: 943-960) in order to identify the optimal composite set. Based on previous results of NLpoly 1-10, NLpoly11-13 (SEQ ID NOS: 961-966) were designed and tested for the same purpose. Mutant NLpolys were generated as previously described in Example 1. Single colony of each non-luminescent polypeptide mutant was grown according to the procedure used in Example 6. The bacterial cultures were also induced according to the procedure used in Example 6. Luminescence was assayed and detected according to the procedure used in Example 6 expect NLpep53 *E. coli* clarified lysate was used at 1:11.85 dilution.

FIG. 24 demonstrates the luminescence of NLpolys containing multiple mutations.

Example 15

Substrate Specificity of Non-Luminescent Polypeptide Mutants

The following example investigates the substrate specificity of the non-luminescent polypeptide mutants. Luminescence generated from luminescent complexes formed from various non-luminescent polypeptide mutants, either Furimazine or coelenterazine as a substrate, and various non-luminescent peptides.

HEK 293 cells were plated at 100,000 cells/ml into wells of a 24 well plates containing 0.5 ml DMEM+10% FBS (50,000/well). The cells were incubated in a 37° C. 5% $CO_2$ incubator overnight. DNA for expression of each non-luminescent polypeptide mutant was transfected in duplicate. 1 ug plasmid DNA containing a non-luminescent polypeptide mutant was mixed with OptiMEM (Life Technologies) to a final volume of 52 ul. 3.3 μl of Fugene HD (Promega Corporation) was added, and samples incubated for 15 minutes at room temperature. 25 μl of each sample mixture was added to two wells and incubated overnight in a 37° C., 5% $CO_2$ incubator overnight. After overnight incubation, the growth media was removed and 0.5 ml DMEM (without phenol red)+0.1% PRIONEX added. The cells were then frozen on dry ice (for how long) and thawed prior to detecting luminescence.

Figure 25:
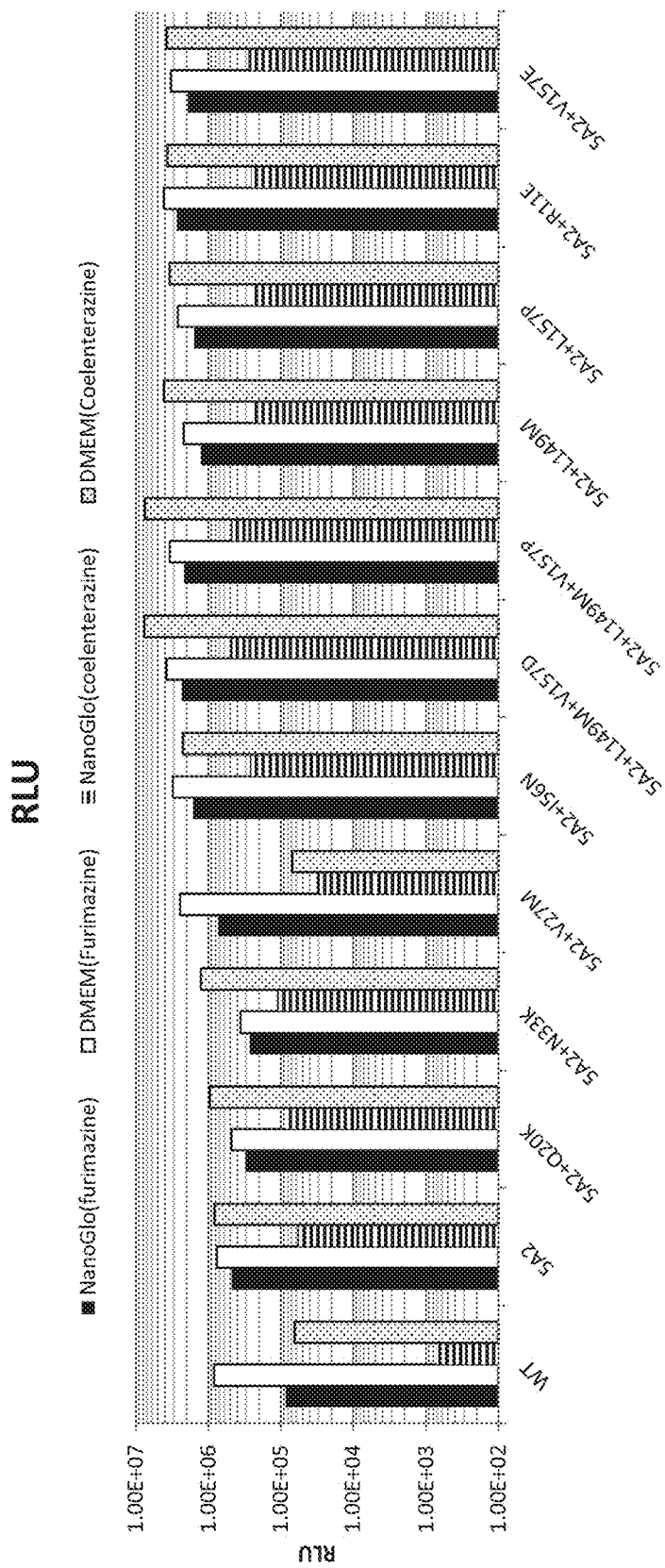
FIG. 25 shows a graph of the luminescence of various NLpolys with NLpep53 with NANOGLO or DMEM buffer and furimazine or coelenterazine substrate.
Figure 26:
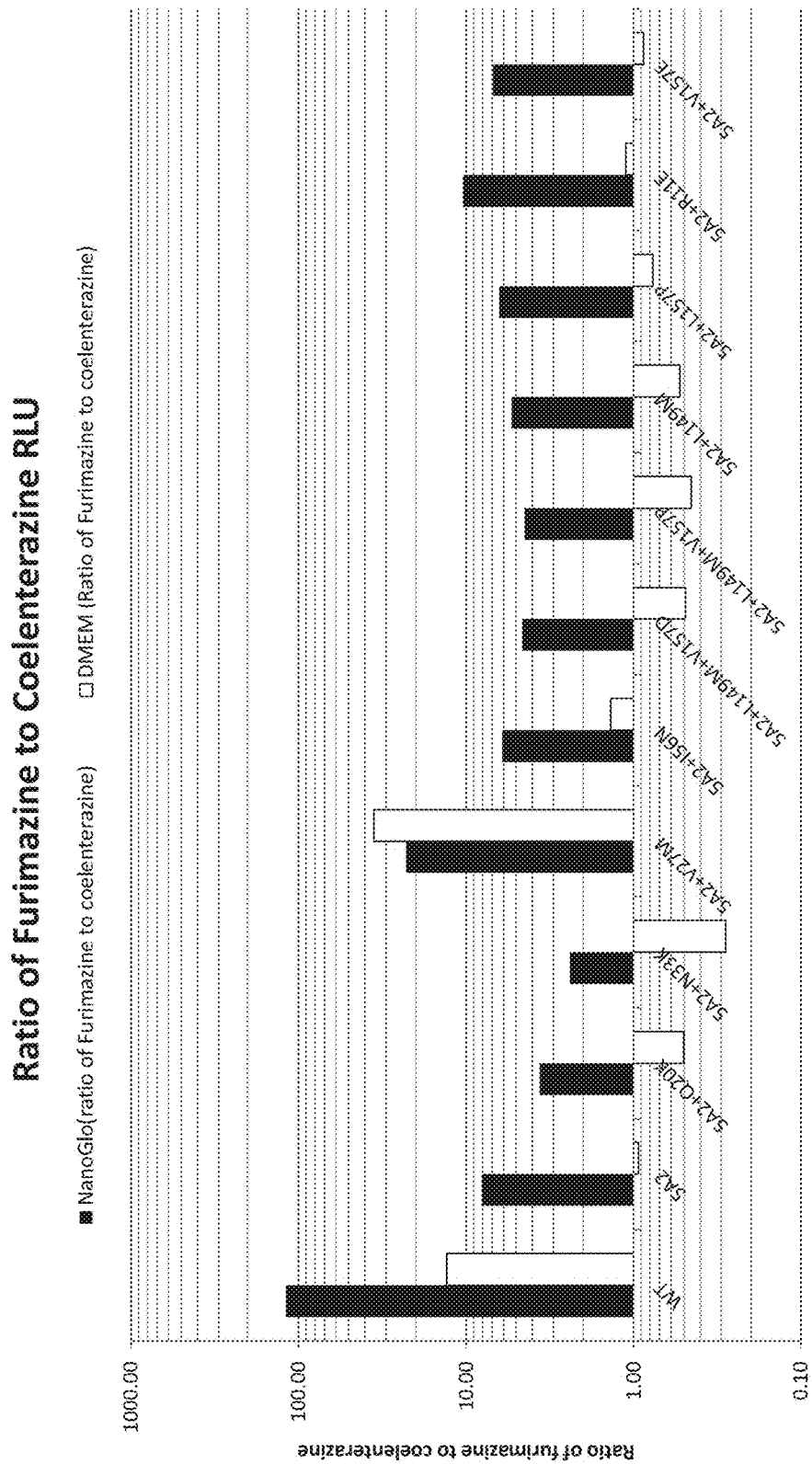
FIG. 26 shows a graph comparing luminescence in the presence of a ratio of furimazine with coelenterazine for various NLpolys and NLpep53.

In FIGS. 25-26, luminescence was assayed and detected according to the procedure used in Example 6, except NLpep53 *E. coli* clarified lysate was used at 1:10 dilution and either Furimazine or coelenterazine in either NANO-GLO Luciferase Assay buffer or DMEM were used. This data demonstrates the luminescence of NLpolys in NANO-GLO and DMEM with either Furimazine or Coelenterazine as the substrate. This indicates the substrate specificity (Furimazine versus Coelenterazine) of the NLpoly in both NANOGLO and DMEM.

Figure 27:
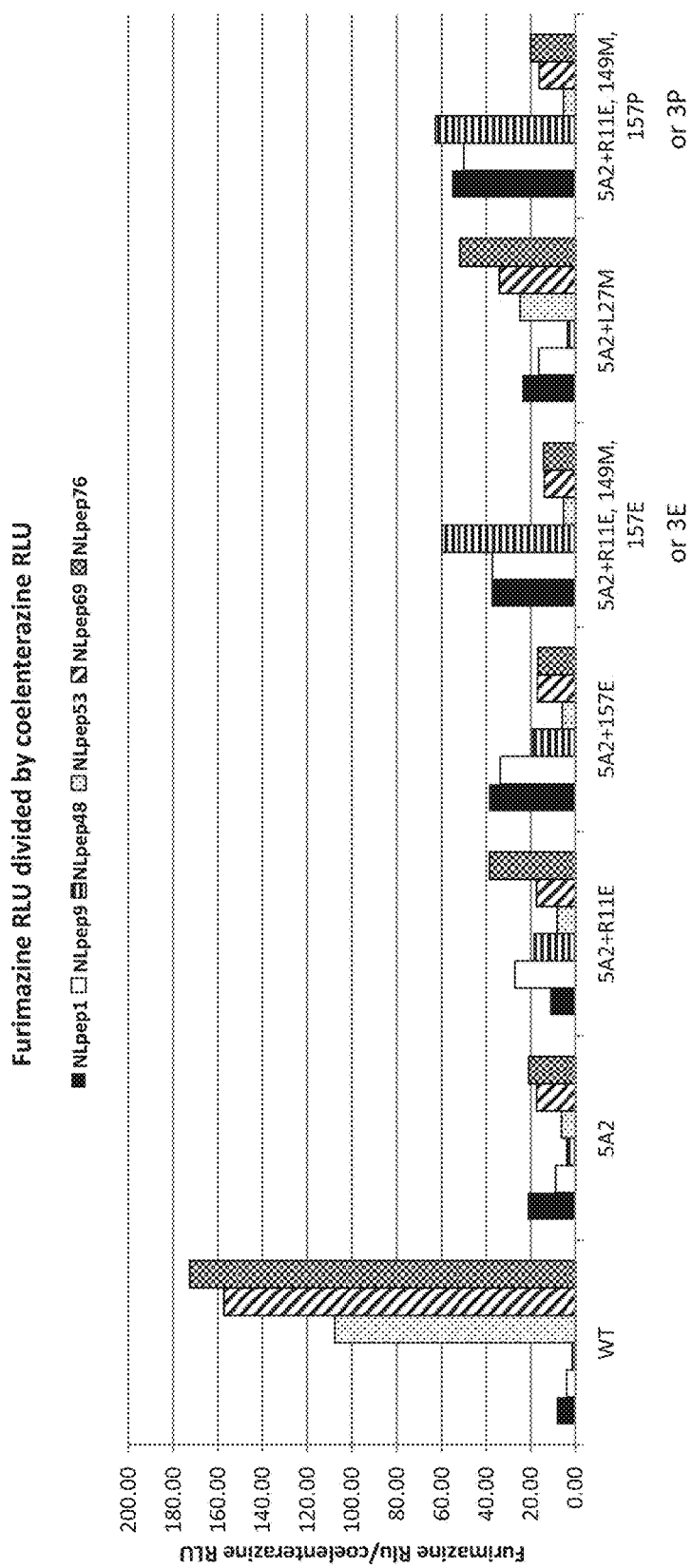
FIG. 27 shows a graph comparing luminescence in the presence of a ratio of furimazine to coelenterazine for various NLpolys and NLpep53.

In FIG. 27, luminescence was assayed and detected according to the procedure used in Example 6, except *E. coli* clarified lysate from various non-luminescent peptides (NLpep1, NLpep9, NLpep48, NLpep53, NLpep69 or NLpep76) were used at 1:10 dilution. In addition, either Furimazine or coelenterazine in either NANOGLO Luciferase Assay buffer were used. This data demonstrates the substrate specificity of NLpoly/NLpep pairs.

Figure 28:
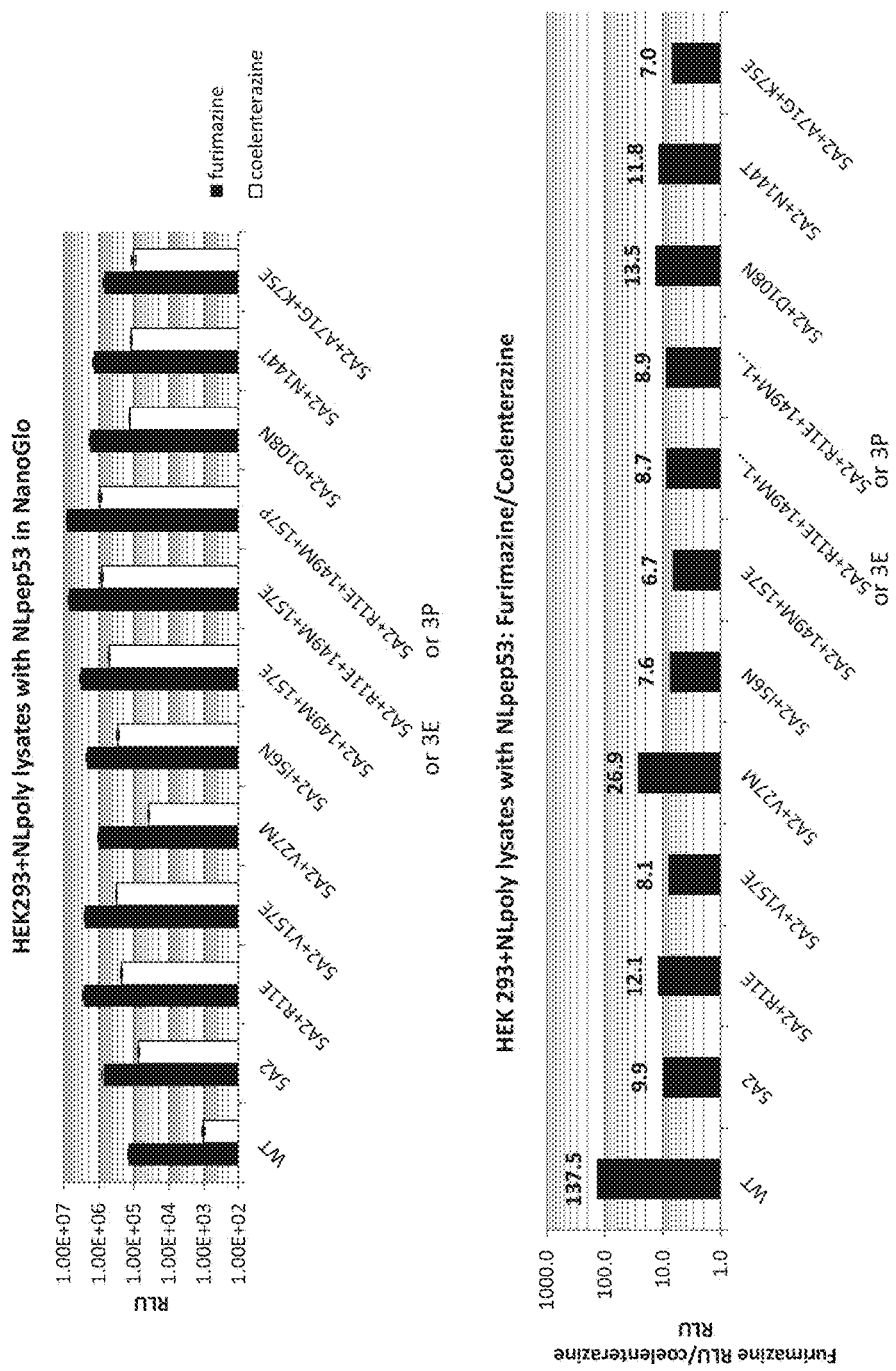
FIG. 28 shows a graph comparing luminescence in the presence of furimazine with coelenterazine for various NLpolys and NLpep53 in HEK293 cell lysate.

In FIG. 28, luminescence was assayed and detected by separately diluting NLpep53-HT fusion 1:10 and the non-luminescent polypeptide lysates 1:10 in DMEM+0.1% PRIONEX. 20 μl of non-luminescent peptide and 20 μl non-luminescent polypeptide were then combined and incubated for 10 minutes at room temperature. 40 μl of NANOGLO Buffer with 100 uM Furimazine or DMEM with 0.1% PRIONEX and 20 uM Furimazine was then added to the samples, and luminescence detected on GLOMAX Multi. This data demonstrates the substrate specificity of NLpolys expressed in HEK293 cells.

Figure 29:
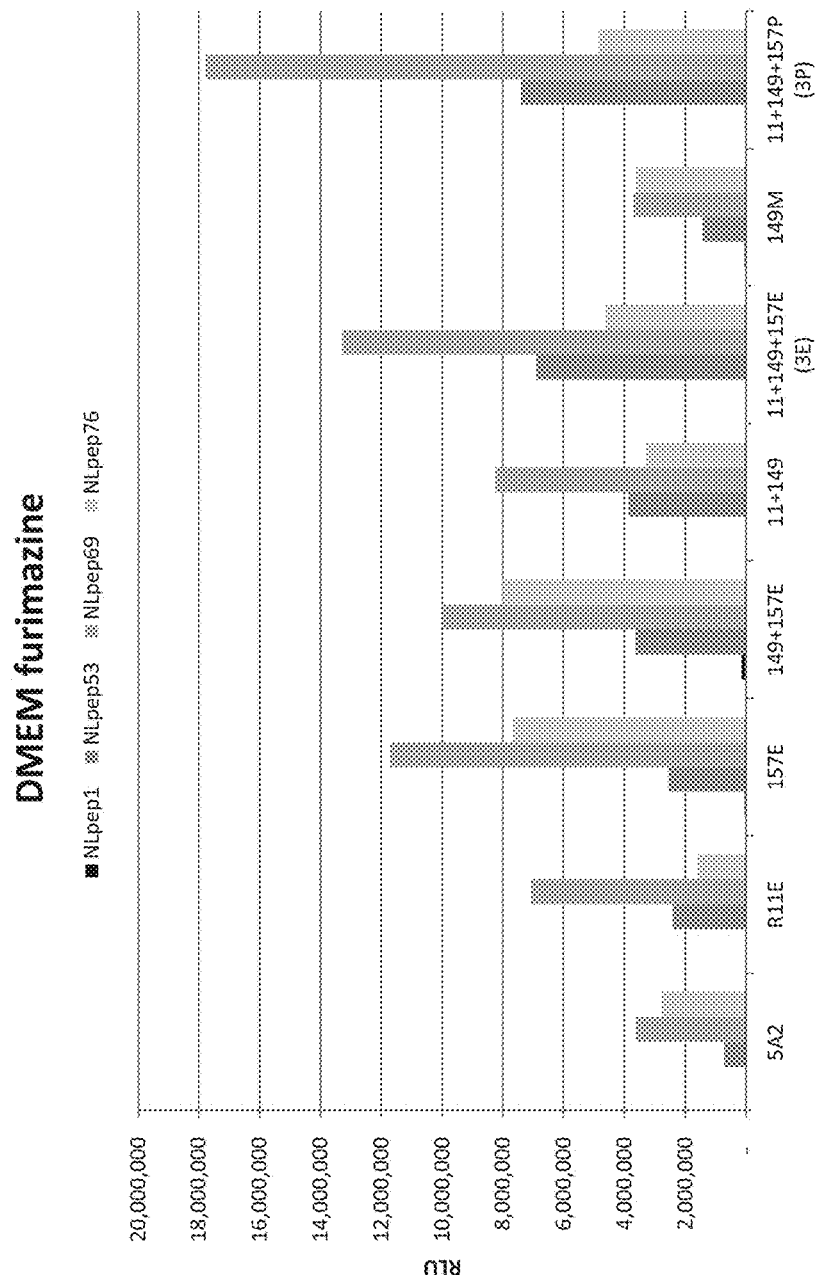
FIG. 29 shows a graph of the luminescence of various combinations of NLpoly and NLpep pairs in DMEM buffer with furimazine.

In FIG. 29, luminescence was assayed and detected by separately diluting NLpep1-HT, NLpep53-HT, NLpep69-HT or NLpep76-HT fusion 1:10 and the non-luminescent polypeptide lysates 1:10 in DMEM+0.1% PRIONEX. 20 μl of non-luminescent peptide and 20 μl non-luminescent polypeptide were then combined and incubated for 10 minutes at room temperature. 40 μl of NANOGLO Buffer with 100 uM Furimazine or DMEM with 0.1% PRIONEX and 20 uM Furimazine was then added to the samples, and luminescence detected on GLOMAX Multi. This data demonstrates the luminescence of NLpolys expressed in mammalian cells and assayed with various NLpeps.

Example 16

Signal-to-Background of Non-Luminescent Polypeptide Mutants with Furimazine or Coelenterazine The following example investigates signal-to-background of the non-luminescent polypeptide mutants. Luminescence generated from various non-luminescent polypeptide mutants was measured using either Furimazine or coelenterazine as a substrate as well as with various non-luminescent peptides.

Figure 30:
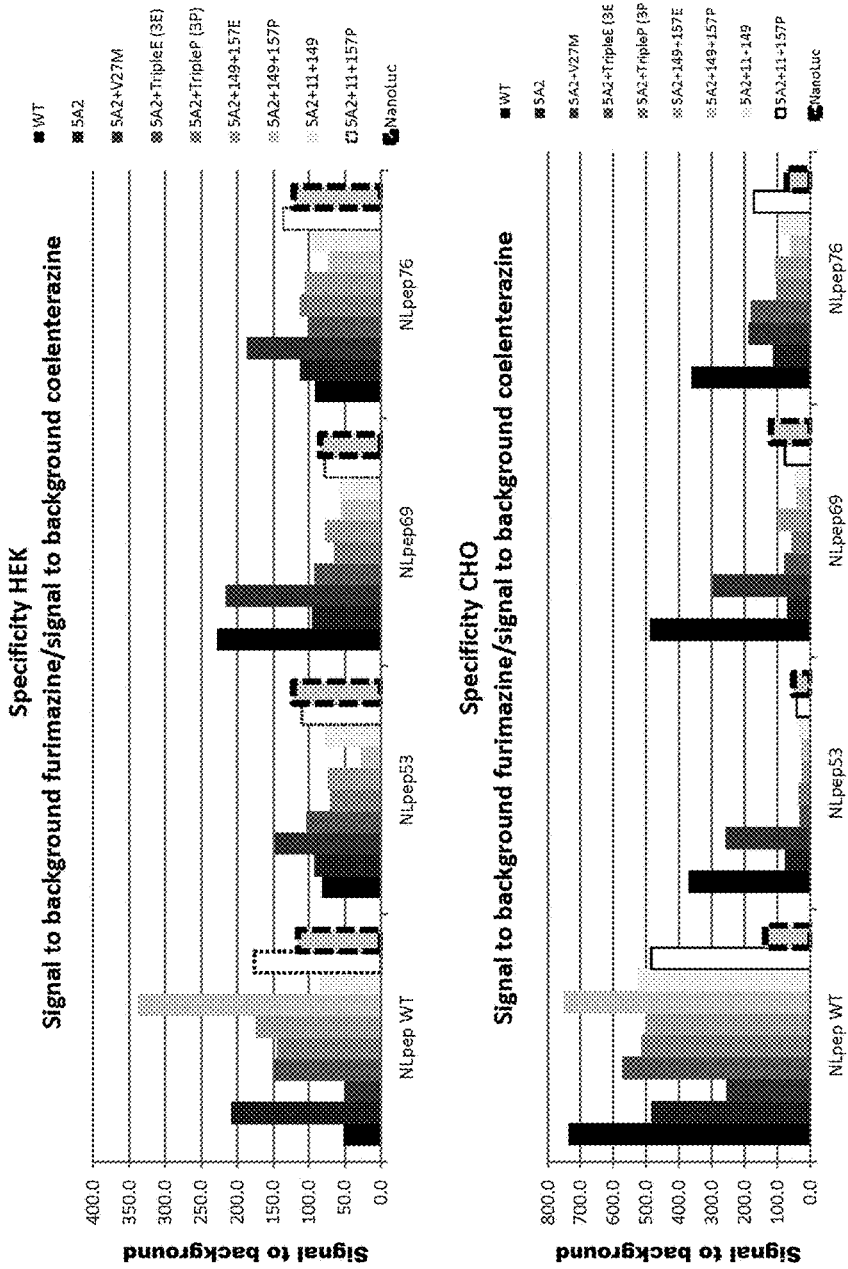
FIG. 30 shows a graph of the signal/background luminescence of various combinations of NLpoly and NLpep pairs in DMEM buffer with furimazine.

HEK 293 cells were plated at 15,000 cells/well in 100 µl DMEM+10% FBS into wells of 96-well plates. The cells were incubated in a 37° C., 5% $CO_2$ incubator overnight. Transfection complexes were prepared by adding 0.66 ug each of plasmid DNA for expression of a non-luminescent polypeptide mutant and a non-luminescent peptide mutant plasmid to a final volume of 31 µl in OptiMem. 2 µl Fugene HD was added to each transfection complex and incubated for 15 minutes at room temperature. For each peptide/polypeptide combination, 5 µl of a transfection complex was added to 6 wells of the 96-well plate and grown overnight at 37 C in $CO_2$ incubator. After overnight incubation, the growth media was removed and replaced with $CO_2$— independent media containing either 20 uM coelenterazine or 20 uM Furimazine. The samples were incubated for 10 minutes at 37° C., and kinetics measured over the course of 1 hour at 37° C. on a GLOMAX Multi+. FIG. 30 demonstrates the substrate specificity of various NLpoly/NLpep pairs when the NLpoly is expressed in mammalian cells.

Example 17

Luminescence and Substrate Specificity

The following example investigates the luminescence and substrate specificity of various non-luminescent polypeptide mutants with NLpep69 and using either Furimazine or coelenterazine as a substrate.

Figure 31:
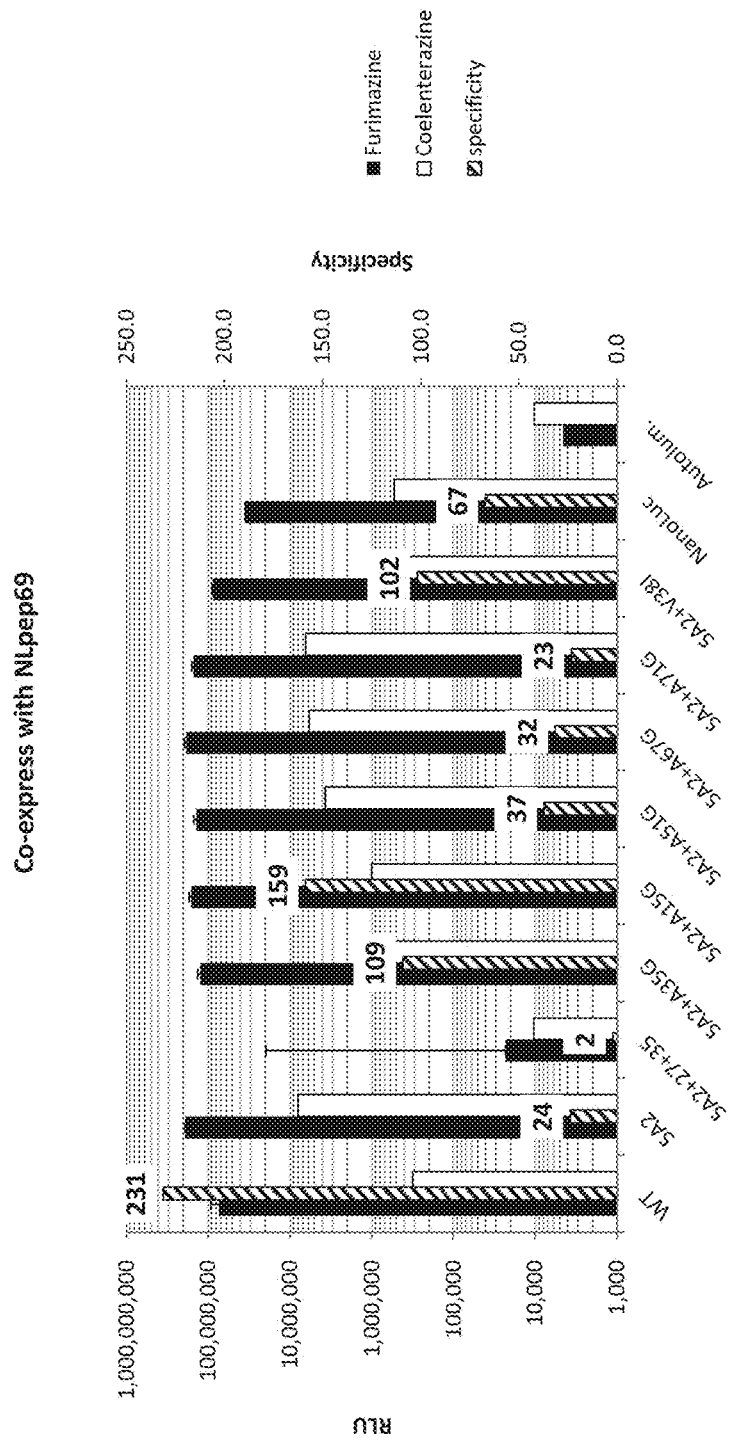
FIG. 31 shows a graph of luminescence and substrate specificity of various NLpoly mutants with NLpep69 using either furimazine or coelenterazine as a substrate.

CHO cells were plated at 20,000 cells/well in 100 µl of DMEM+10% FBS into wells of 96-well plates. The cells were incubated in a 37° C., 5% $CO_2$ incubator overnight. Transfection complexes were prepared by adding 0.66 ug each of plasmid DNA for expression of a non-luminescent polypeptide mutant and a non-luminescent peptide mutant plasmid to a final volume of 31 µl in OptiMem. 2 µl Fugene HD was added to each transfection complex and incubated for 15 minutes at room temperature. For each peptide/polypeptide combination, 5 µl of transfection complex was added to 6 wells of the 96-well plate and grown overnight at 37 C in $CO_2$ incubator. After overnight incubation, the growth media was removed and replaced with $CO_2$— independent media containing either 20 uM coelenterazine or 20 uM Furimazine. The samples were incubated for 10 minutes at 37° C., and kinetics measured over the course of 1 hour at 37° C. on a GLOMAX Multi+. FIG. 31 demonstrates the substrate specificity when NLpolys are coexpressed in mammalian cells with NLpep69.

Example 18

Luminescence and Substrate Specificity Between Live-Cell and Lytic Conditions

The following example investigates the luminescence and substrate specificity of various non-luminescent polypeptide mutants with NLpep69, NLpep78 or NLpep79, using either Furimazine or coelenterazine as a substrate and under either lytic or live cell conditions.

Figure 32:
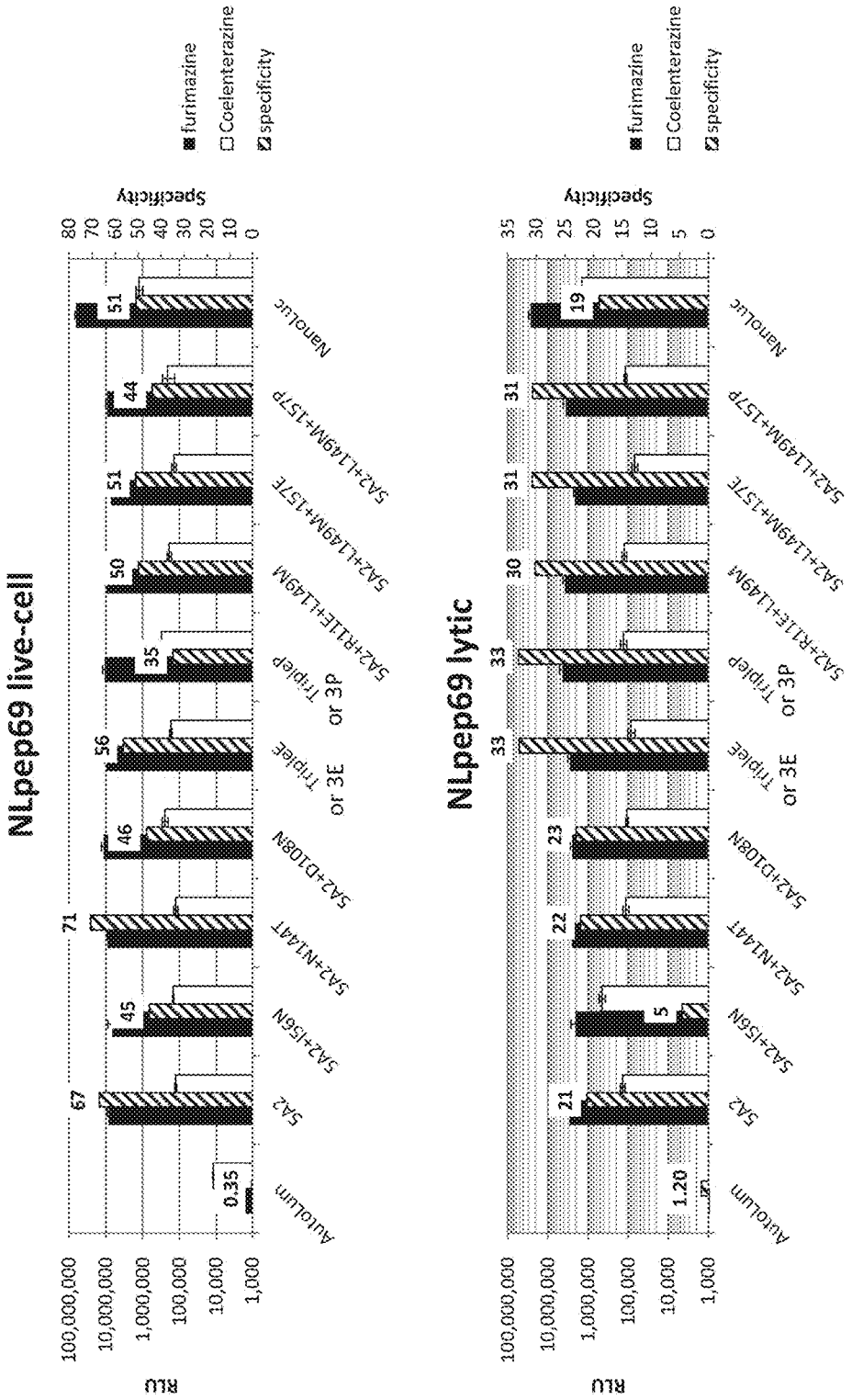
FIG. 32 shows a comparison of luminescence and substrate specificity of various NLpoly mutants with NLpep69 using either furimazine or coelenterazine as a substrate, and under either lytic (bottom graph) or live cell (top graph) conditions.
Figure 33:
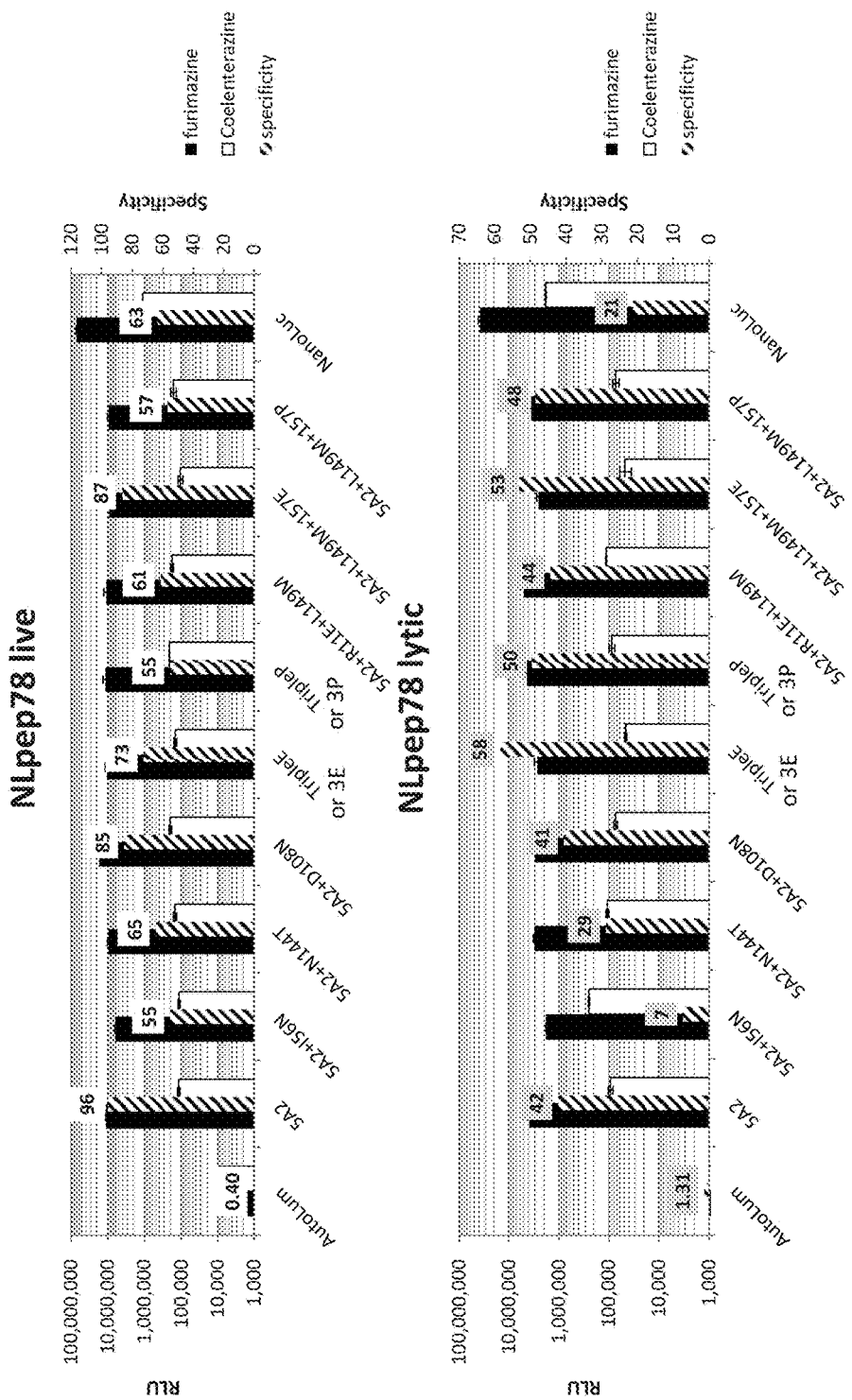
FIG. 33 shows a comparison of luminescence and substrate specificity of NLpoly mutants with NLpep78 using either furimazine or coelenterazine as a substrate, and under either lytic (bottom graph) or live cell (top graph) conditions.
Figure 34:
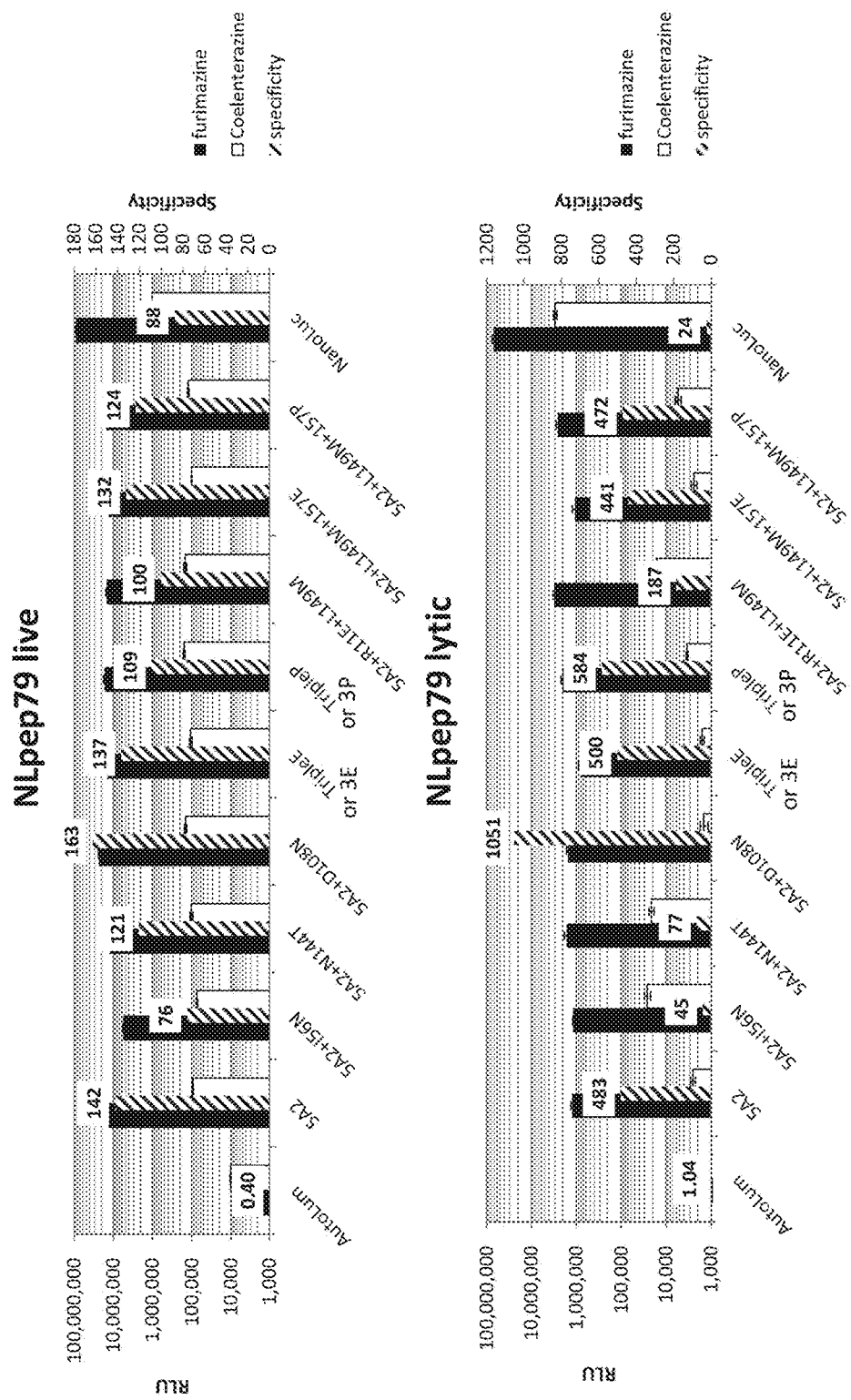
FIG. 34 shows a comparison of luminescence and substrate specificity of various NLpoly mutants with NLpep79 using either furimazine or coelenterazine as a substrate, and under either lytic (bottom graph) or live cell (top graph) conditions.

HEK 293 cells were plated at 15,000 cells/well in 10011 DMEM+10% FBS into wells of 96-well plates. The cells were incubated in a 37° C., 5% $CO_2$ incubator overnight. Transfection complexes were prepared by adding 0.66 ug each of plasmid DNA for expression of a non-luminescent polypeptide mutant and a non-luminescent peptide mutant plasmid to a final volume of 31 µl in OptiMem. 2 µl Fugene HD was added to each transfection complex and incubated for 15 minutes at room temperature. For each NLpoly-NLpep combination, 5 µl of transfection complex was added to 6 wells of the 96-well plate and grown overnight at 37 C in $CO_2$ incubator. After overnight incubation, the growth media was removed and replaced with $CO_2$— independent media containing either 20 uM coelenterazine or 20 uM Furimazine. The samples were incubated for 10 minutes at 37° C., and kinetics measured over the course of 1 hour at 37° C. on a GLOMAX Multi+. FIGS. 32-34 demonstrate the substrate specificity of NLPolys coexpressed in mammalian cells with NLpep69, 78, or 79 in live-cell and lytic formats.

Example 19

Comparison of Non-Luminescent Polypeptide Mutants Expressed in E. Coli

Figure 35:
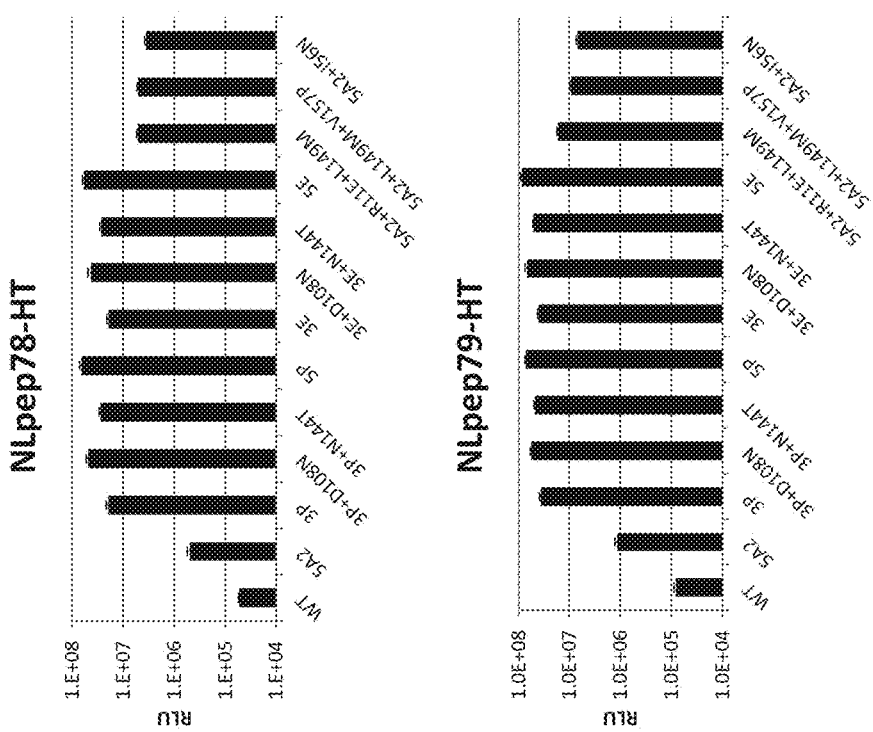
FIG. 35 shows graphs of the luminescence of NLpep78-HT (top) and NLpep79-HT (bottom) fusions in the presence of various NLpolys.

A single colony of each non-luminescent polypeptide was grown according to the procedure used in Example 7. The bacterial cultures were also induced according to the procedure used in Example 7. Luminescence was assayed and detected according to the procedure used in Example 7 except NLpep78-HT or NLpep79-HT at 1:1,000 dilution was used. FIG. 35 demonstrates the luminescence of NLpolys expressed in E. coli and assayed with NLpep78 or 79.

Example 20

Figure 36:
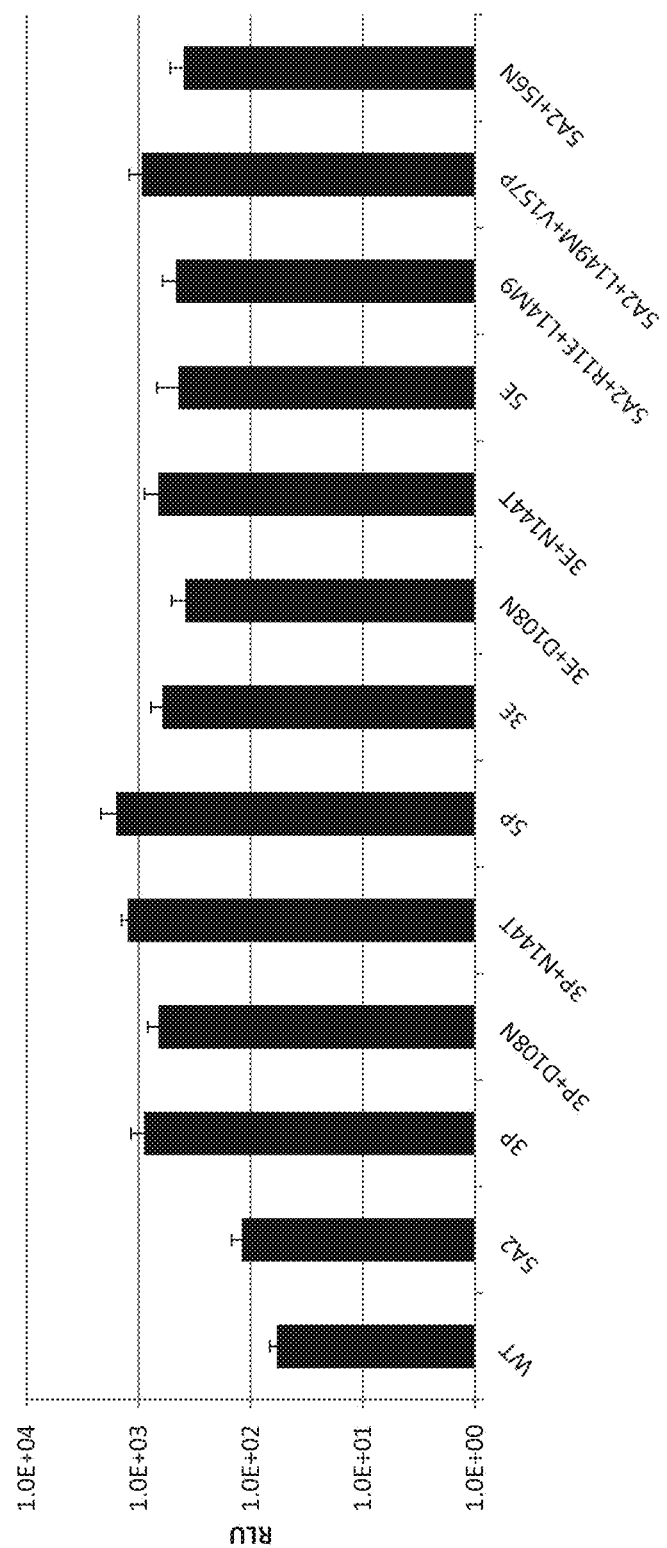
FIG. 36 shows a graph of the luminescence of various NLpolys in the absence of NLpep.

Ability of Non-Luminescent Polypeptide Clones to Produce Luminescence without Complementing Non-Luminescent Peptide A single colony of each non-luminescent polypeptide was grown according to the procedure used in Example 7. The bacterial cultures were also induced according to the procedure used in Example 7. Luminescence was assayed and detected according to the procedure used in Example 7 except no non-luminescent peptide was added to the assay buffer. FIG. 36 demonstrates the luminescence of NLpolys expressed in E. coli and assayed in the absence of NLpep.

Example 21

Figure 37:
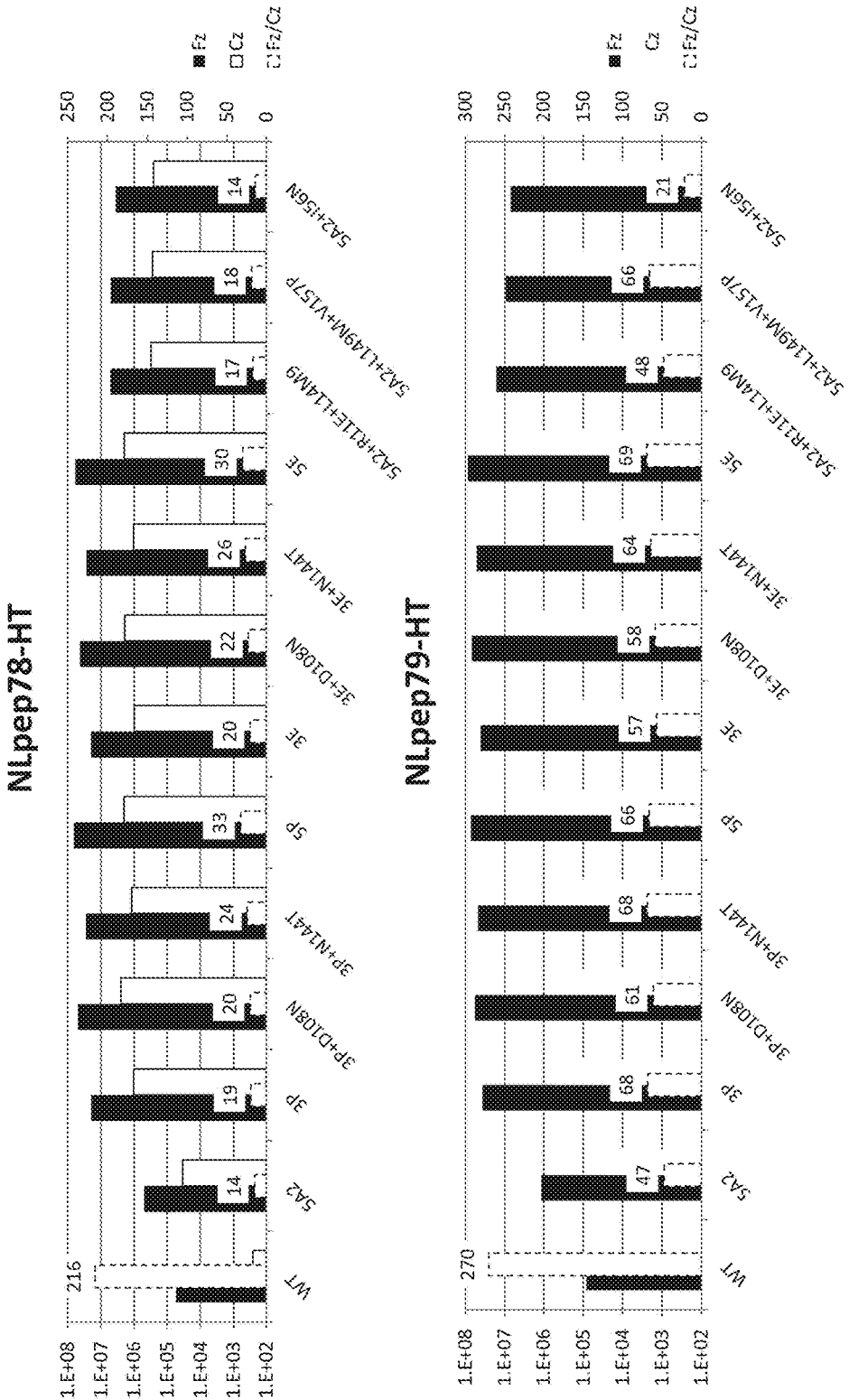
FIG. 37 shows graphs of the luminescence of NLpep78-HT (top) and NLpep79-HT (bottom) fusions in the presence of various NLpolys with either furimazine or coelenterazine substrates.

Substrate Specificity of Non-Luminescent Polypeptide Mutants Expressed in E. Coli A single colony of each non-luminescent polypeptide was grown according to the procedure used in Example 7. The bacterial cultures were also induced according to the procedure used in Example 7. Luminescence was assayed and detected according to the procedure used in Example except either Furimazine or coelenterazine was mixed with NANO-GLO Assay Buffer. FIG. 37 demonstrates the substrate specificity of NLpolys expressed in *E. coli* and assayed with NLpep78 or 79.

Example 22

Improved Luminescence of Non-Luminescent Polypeptide Mutants with NLpep78

Complementation of the non-luminescent polypeptide mutants with NLpep78-HT was demonstrated in CHO and Hela cells.

Figure 38:
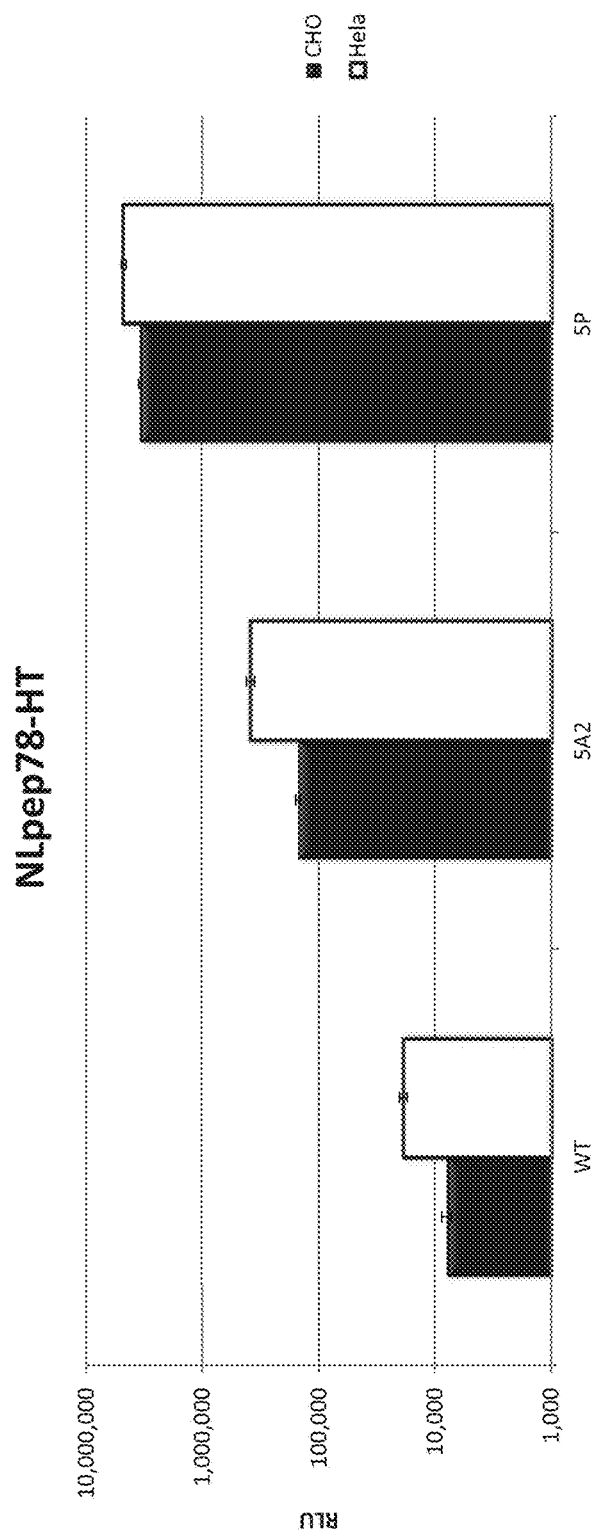
FIG. 38 shows a graph of the luminescence of NLpep78-HT with various NLpolys expressed in CHO and HeLa cells.

CHO and Hela cells (CHO: 100,000 seeded the day prior to transfection; Hela: 50,000 seeded the day prior to transfection) were transfected with 5 ng of a non-luminescent polypeptide mutant 5A2 or 5P or with wild-type non-luminescent polypeptide using Fugene HD into wells of a 24-well plate and incubated at 37° C. overnight. After the overnight incubation, the media was replaced with DMEM without phenol red, and the cells frozen at −80° C. for 30 minutes. The cells were then thawed and transferred to a 1.5 ml tube. The cell lysates were then diluted 1:10 DMEM without phenol red, 20 μl mixed with NLpep78 (NLpep78-HT7 *E. coli* lysate diluted 1:1,000 in DMEM without phenol red) and shaken at room temperature for 10 minutes. 40 μl DMEM without phenol red and 20 uM Furimazine were added and luminescence measured on a GLOMAX with a 0.5 second integration. FIG. 38 demonstrates the luminescence of NLpolys expressed in mammalian cells and assayed with NLpep78.

Example 23

Non-Luminescent Polypeptide Fusions and Normalizing Non-Luminescent Polypeptide Concentrations A comparison of raw and normalized luminescence from non-luminescent polypeptide fused to either firefly luciferase (FIG. 39) or click beetle red luciferase (FIG. 40) were performed to provide insight into how much benefit, e.g., in expression, solubility and/or stability, stems from the concentration of the non-luminescent polypeptide as well as complementation as a fusion non-luminescent polypeptide.

Figure 39:
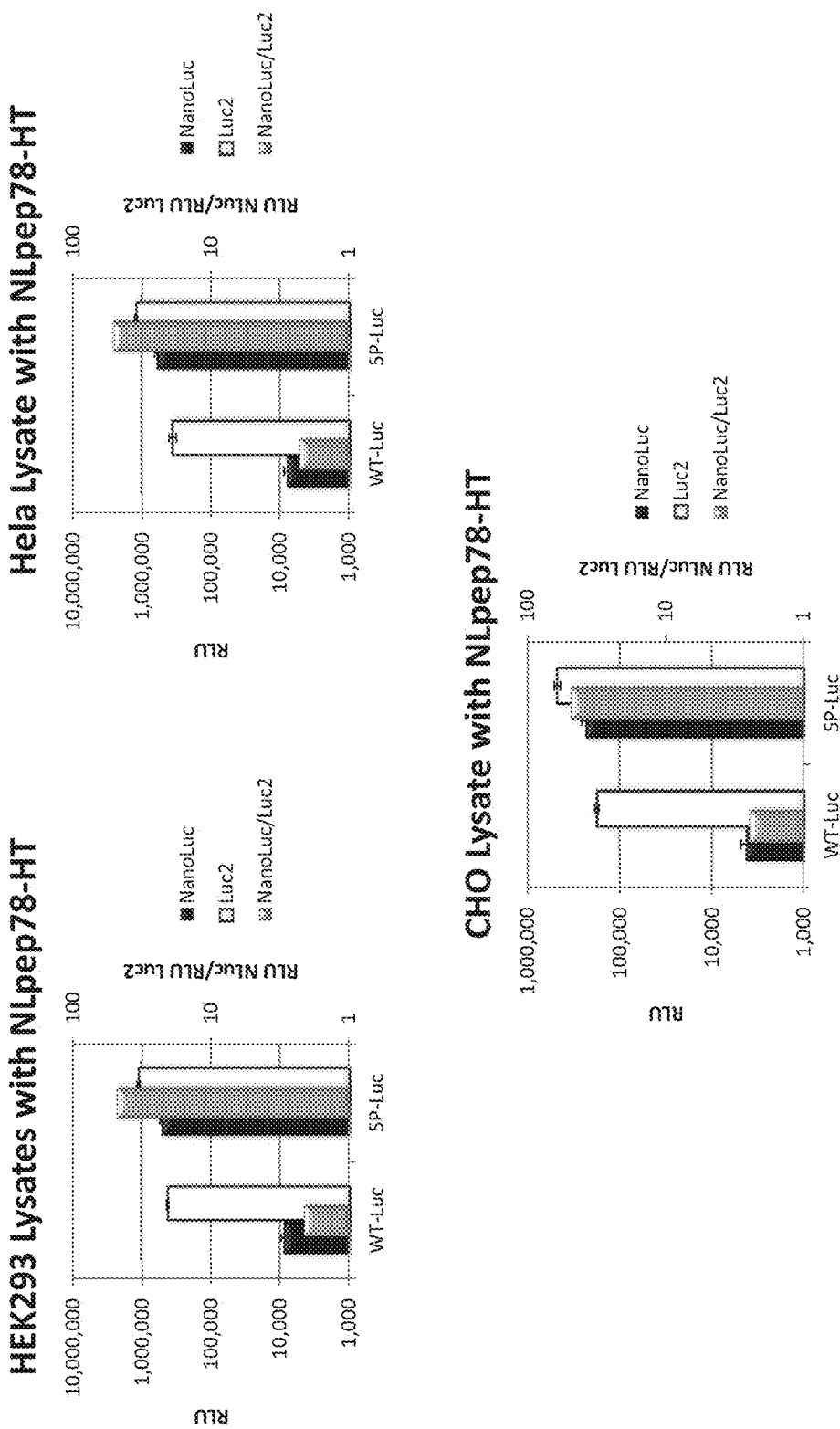
FIG. 39 shows graphs of raw and normalized luminescence from NLpoly fused to firefly luciferase expressed in HEK293, Hela, and CHO cell lysates.
Figure 40:
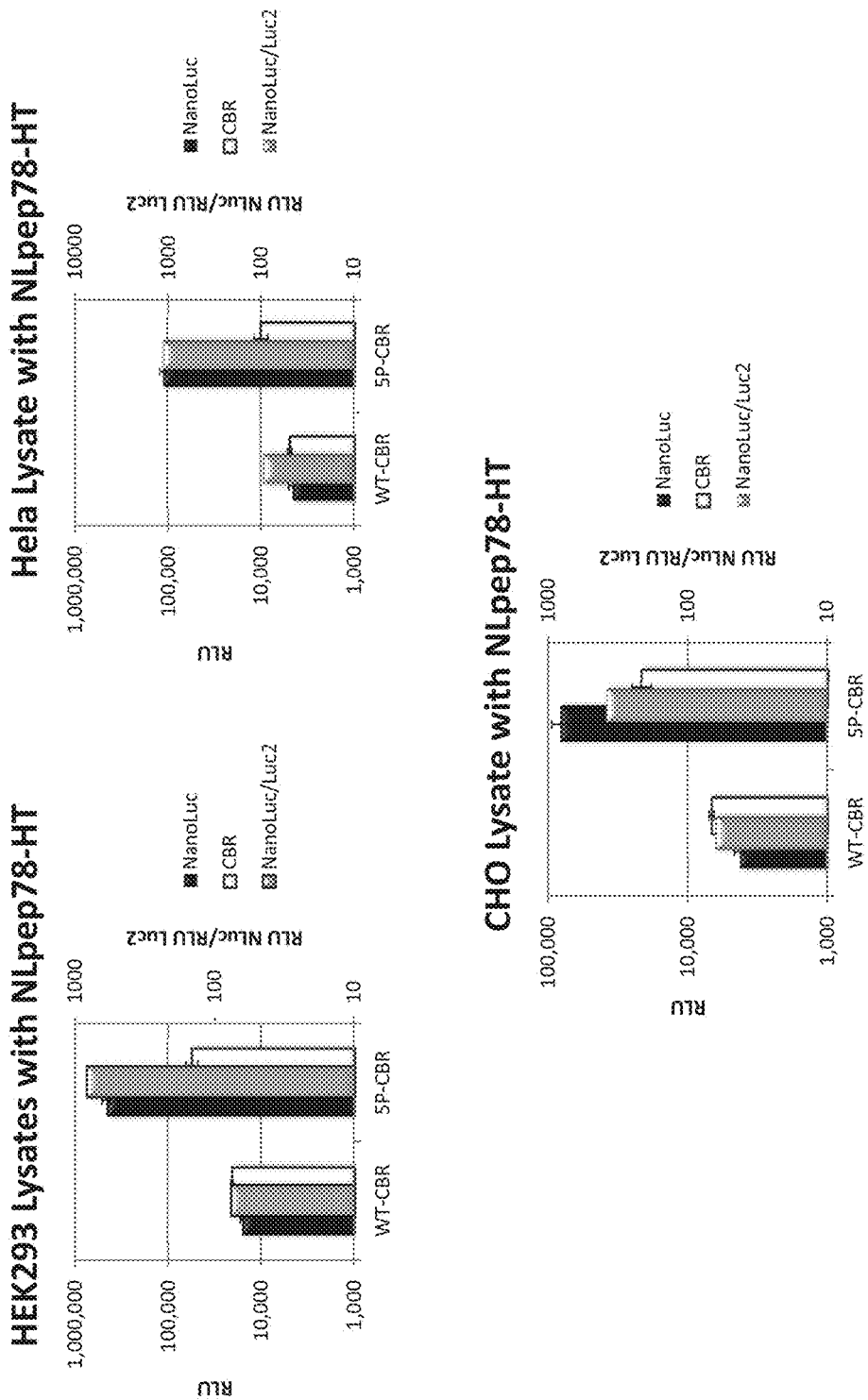
FIG. 40 shows graphs of raw and normalized luminescence from NLpoly fused to click beetle red luciferase expressed in HEK293, Hela, and CHO cell lysates.

HEK293, Hela or CHO cells were transfected with 5 ng 5P NLpoly-firefly luciferase fusion, 5P NLpoly-click beetle luciferase fusion, wild-type 5P-firefly luciferase fusion or wild-type 5P-click beetle luciferase fusion according to the procedure in Example 22. Lysates were also prepared according to Example 22. The cell lysates were then diluted 1:10 DMEM without phenol red, 20 μl mixed with NLpep78 (diluted 1:100 in DMEM without phenol red: *E. coli* lysate) and shaken at room temperature for 10 minutes. 40 μl NANOGLO with 20 uM Furimazine or Bright-Glo (Promega Corporation) was added and luminescence measured on a GLOMAX with 0.5 second integration. FIGS. 39 and 40 demonstrate the specific activity of 5P versus WT NLpoly expressed in mammalian cells and assayed with NLpep78.

Example 24

Complementation in Live Cells

This example demonstrates complementation in live-cells using either wild-type or 5P NLpoly.

Figure 41:
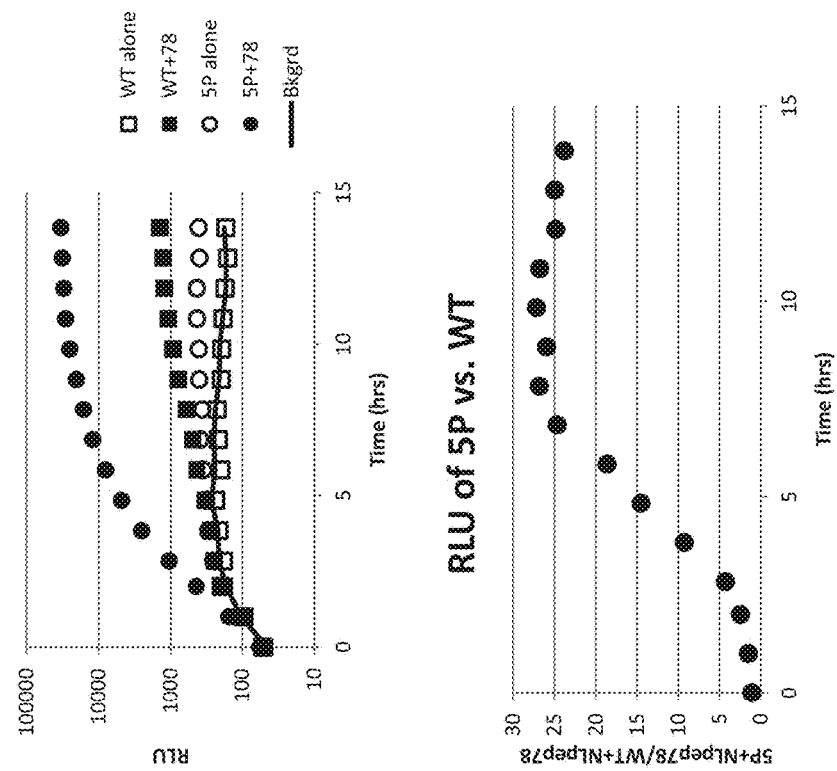
FIG. 41 shows a graphs of luminescence of complementation in live cells using either NLpoly wild-type or 5P.

Hela cells plated into wells of 96-well plated, transfected with 0.5 ng of wild-type or 5P non-luminescent polypeptide plasmid DNA using Fugene HD and incubated at 37° C. overnight. After the overnight incubation, the cells were then transfected with 0.5 ng NLpep78-HT plasmid DNA using Fugene HD and incubated at 37° C. for 3 hours. The media was then replaced with $CO_2$-independent media+0.1% FBS and 20 uM PBI-4377 and luminescence measured at 37° C. on a GLOMAX with 0.5 second integration. FIG. 41 demonstrates the live-cell complementation between 5P or WT NLpoly and NLpep78.

Example 25

Complementation in Cell-Free Extract

Figure 42:
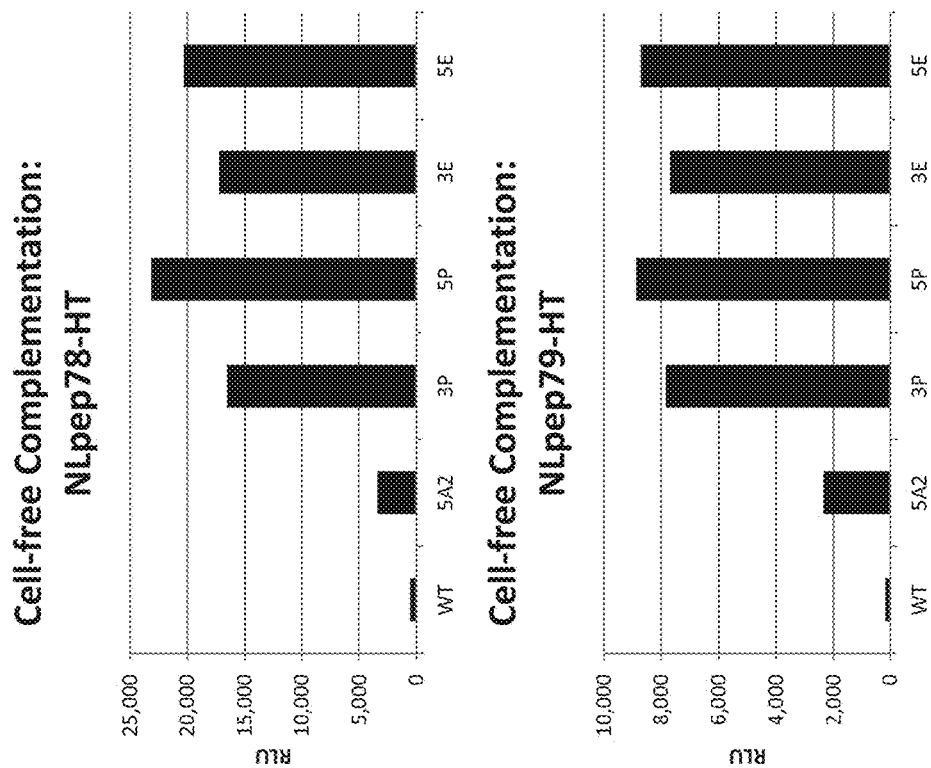
FIG. 42 shows graphs of luminescence of cell-free complementation of NLpep78-HT fusion (top) and NLpep79-HT fusion (bottom) with various NLpolys.

To demonstrate complementation in cell-free extract, 0.5 ug NLpep78-HT and 0.5 ug non-luminescent polypeptide mutant plasmid DNA were mixed with TNT rabbit reticulocyte lysate master mix (Promega Corporation) and incubated at 30° C. for 1 hour. 25 μl of the cell-free expression extract was mixed with 25 μl NANOGLO Luciferase Assay reagent and incubated at room temperature for 10 minutes. Luminescence was measured on a GLOMAX with 0.5 second integration. FIG. 42 demonstrates luminescence from complementing NLpoly/NLpep pairs expressed in a cell-free format.

Example 26

Figure 43:
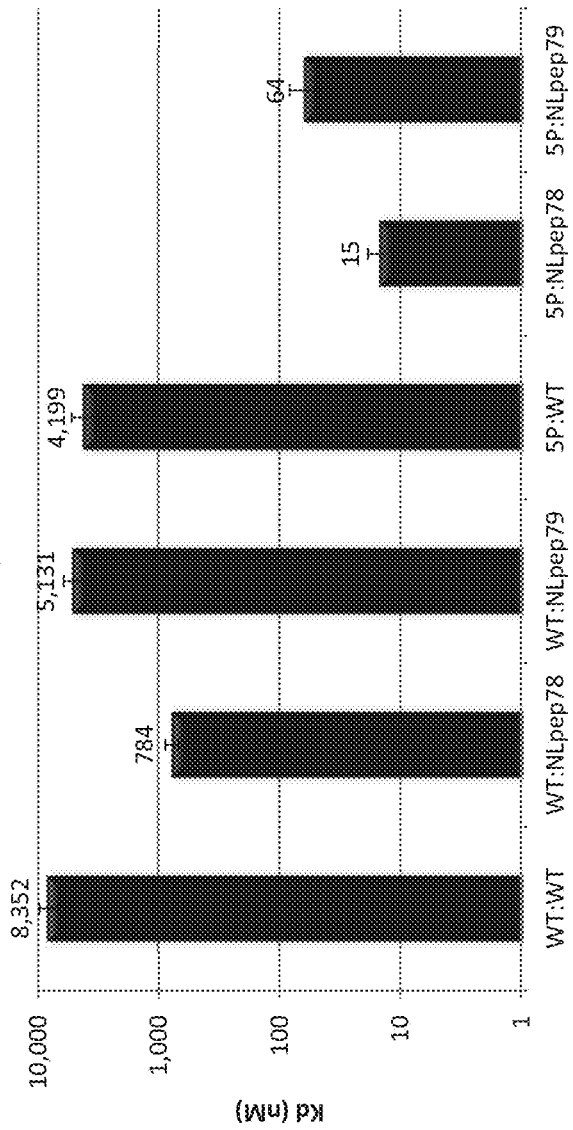
FIG. 43 shows a graph of binding affinities for various combinations of NLpeps and NLpolys expressed in HeLa, HEK293 and CHO cell lysate.
Figure 44:
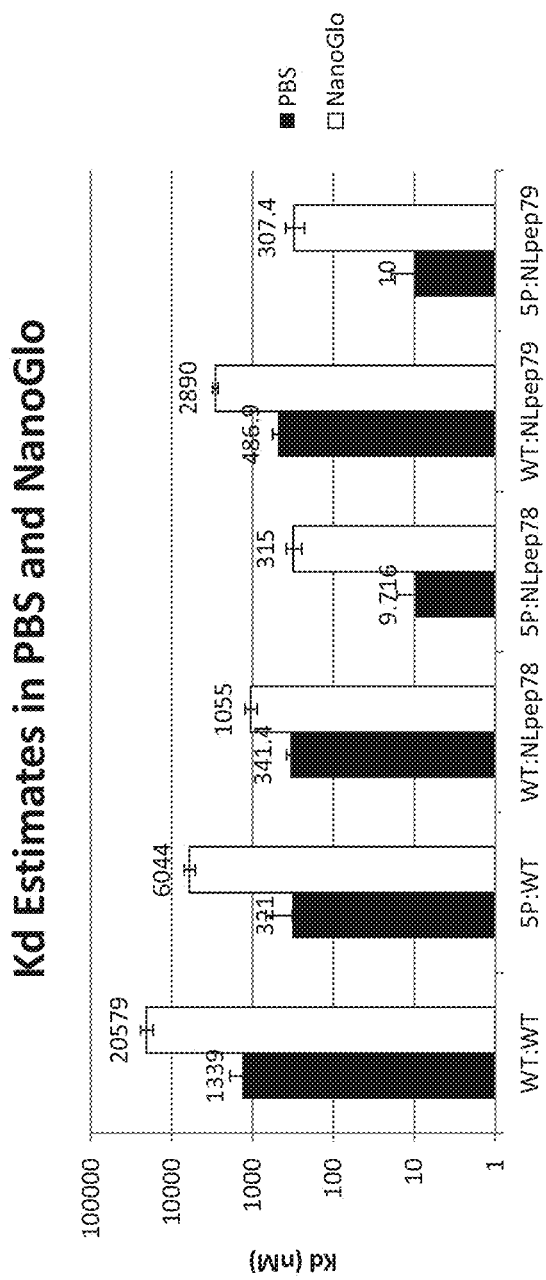
FIG. 44 shows a graph of binding affinities for various combinations of NLpeps and NLpolys in PBS or NANO-GLO buffer.

Binding Affinity of Non-Luminescent Polypeptide Expressed in Mammalian Cells with Synthetic Non-Luminescent Peptide To demonstrate the binding affinity between non-luminescent polypeptide and non-luminescent peptide pairs, non-luminescent polypeptide lysates from Hela, HEK293 and CHO cells were prepared as previously described and diluted 1:10 PBS+0.1% PRIONEX. 4× concentrations of non-luminescent peptide (synthetic) were made in PBS+0.1% PRIONEX. 20 μl of the non-luminescent polypeptide lysate was mixed with 20 μl non-luminescent peptide and shaken at room temperature for 10 minutes. 40 μl of NANO-GLO Luciferase Assay Reagent or PBS+0.1% PRIONEX with Furimazine was added and shaken at room temperature for 10 minutes. Luminescence was detected on a GLOMAX with 0.5 s integration. Kd values were determined using Graphpad Prism. One Site-Specific Binding. FIGS. 43 and 44 demonstrate the dissociation constants measured under various buffer conditions (PBS for complementation then NANOGLO for detection, PBS for complementation and detection, NANOGLO for complementation and detection).

Example 27

Figure 45:
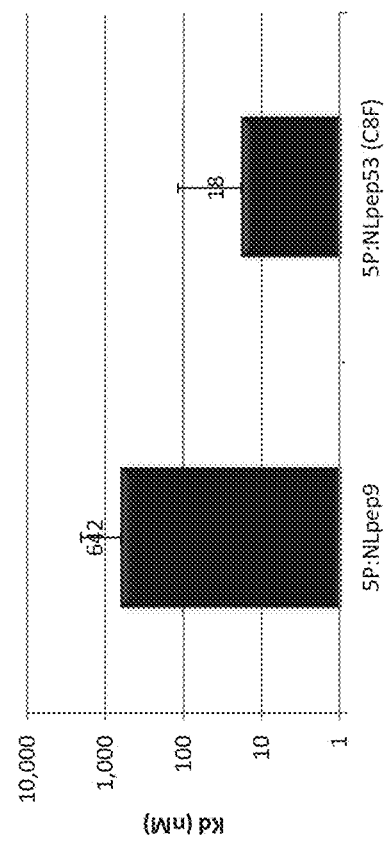
FIG. 45 shows a graph of binding affinities for NLpoly 5P with NLpep9 (SEQ ID NO: 236) or NLpep53 (SEQ ID NO: 324) expressed in HeLa, HEK293 or CHO cell lysate.

Improved Binding Affinity when Cysteine Mutated to Phenylalanine in Non-Luminescent Peptide Mutants To demonstrate improved binding affinity in non-luminescent peptide mutants with a mutated cysteine at the $8^{th}$ residue of the peptide, non-luminescent polypeptide mutant lysates from Hela, HEK293 and CHO cells were prepared as previously described and diluted 1:10 PBS+0.1% PRIONEX. 4× concentrations of non-luminescent peptide (NLpep) were made in PBS+0.1% PRIONEX+10 mM DTT 20 μl of the non-luminescent polypeptide lysate was mixed with 20 µl non-luminescent peptide and shaken at room temperature for 10 minutes. 40 µl of NANOGLO Luciferase Assay Reagent was added and shaken at room temperature for 10 minutes. Luminescence was detected on a GLOMAX with 0.5 s integration. FIG. 45 demonstrates NLpep C8F mutation significantly improves the binding affinity for 5P.

Example 28

Figure 46:
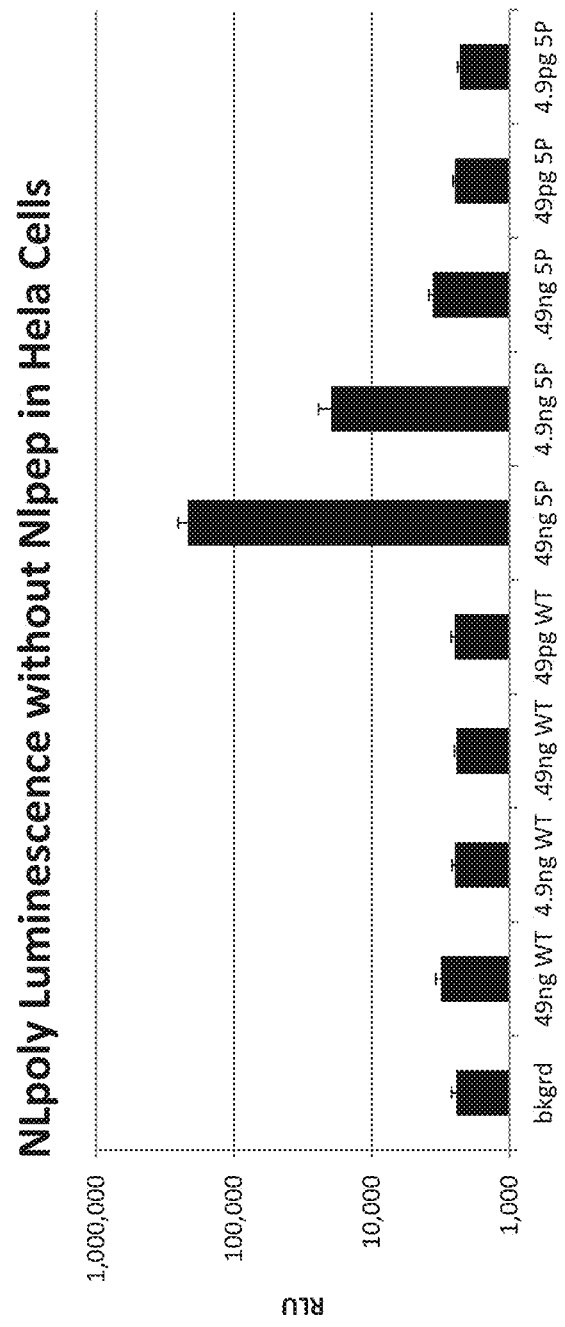
FIG. 46 shows a graph of luminescence of varying amounts of NLpolys in the absence of NLpep.

Detectable Luminescence of Polypeptide Variants without Non-Luminescent Peptide in Hela Cells To demonstrate luminescence in non-luminescent polypeptide without non-luminescent peptide, Hela cells (10,000 seeded the day prior to transfection) in wells of a 96-well plate were transfected with varying amounts of non-luminescent polypeptide+pGEM-3zf Carrier DNA to a total of 50 ng using Fugene HD and incubated 37° C. overnight. After incubation, the media was replaced with $CO_2$-independent media+0.1% FBS+20 uM Furimazine and incubated at 37° C. for 10 minutes, and luminescence detected on a GLOMAX with 0.5 s integration. FIG. 46 demonstrates the luminescence of NLpoly WT or 5P in live Hela cells without NLpep after transfection of various amounts of plasmid DNA.

Example 29

Generation of Additional Non-Luminescent Polypeptide Variants

Additional non-luminescent polypeptide variants: Ile-11 (Ile at residue 11), Val-11, Tyr-11, Glu-11, Glu-157, Pro-157, Asp-157. Ser-157, Met-149, Leu-106, NLpoly11, and NLpoly12 were generated as described below, and their expression analyzed. The additional non-luminescent polypeptide variants were made in the 5A2 non-luminescent polypeptide background.

Fresh individual colonies (KRX) of each additional non-luminescent polypeptide variants were picked and grown overnight in LB+ampicillin (100 ug/ml) at 30° C. and then diluted 1:100 in LB+ampicillin and grown at 37° C. for 2.5 hours (OD600 ~0.5). Rhamnose was added to a final concentration of 0.2%, and the cells were split in triplicate and grown overnight at 25° C. for ~18 h. Cells were lysed using 0.5× Fast Break for 30 minutes at ambient temperature, snap-frozen on dry ice, and stored at –20° C. Upon fast thawing, soluble fractions were prepared by centrifugation at 10K for 15 min at 4° C. Samples were assayed for luminescence on a Tecan Infinite F-500 luminometer.

Figure 49:
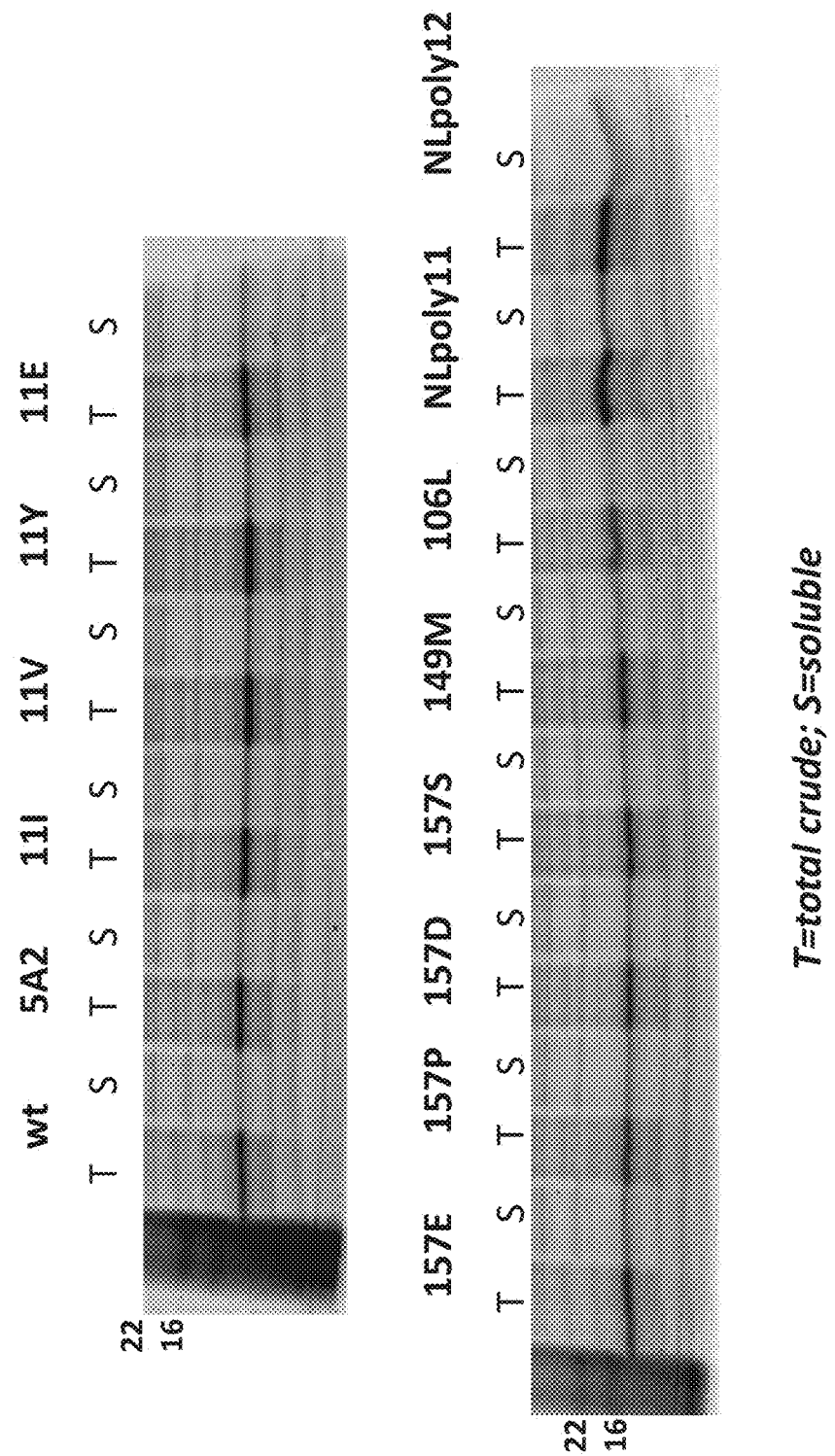
FIG. 49 shows a SDS-PAGE gel of total lysate and soluble fraction of several NLpoly variants

FIG. 49 demonstrates that total lysate and soluble fraction of each non-luminescent polypeptide variant as analyzed by SDS-PAGE. The data provides information about expression, solubility and stability of the additional non-luminescent polypeptide variants. A majority of the additional non-luminescent polypeptide variants produced more protein (total and soluble) than wild-type, but in many cases, the difference is subtle. Improved expression for NLpoly11 and NLpoly12 was more noticeable.

Example 30

Background Luminescence of Additional Non-Luminescent Polypeptide Variants

Figure 47:
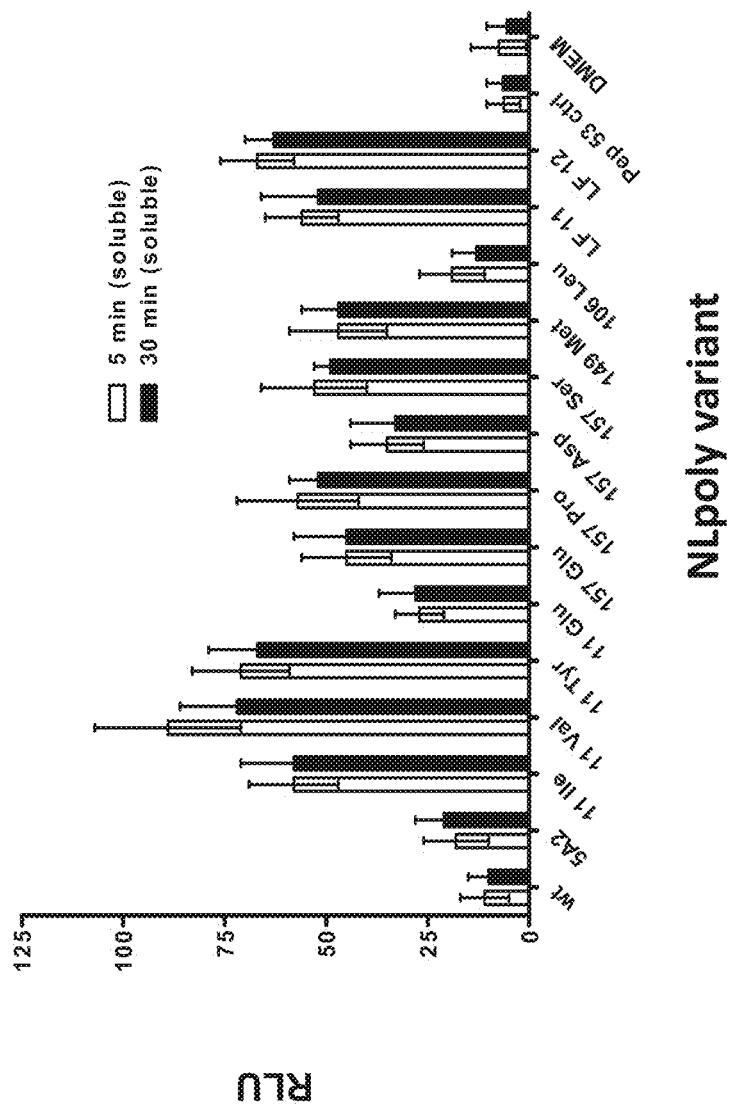
FIG. 47 shows a graph of background luminescence of various NLpoly variants.

The background luminescence of the additional non-luminescent polypeptide variants generated in Example 29 was measured by incubating 25 µl of non-luminescent polypeptide variant lysate with 25 µl DMEM at room temperature for 10 minutes. 50 µl NANOGLO Luciferase Assay Reagent was then added, and luminescence measured at 5 and 30 minutes on a Tecan Infinite F500. NLpep53 (Pep 53) alone and DMEM (DMEM) alone were used as controls. FIG. 47 demonstrates that a majority of the additional non-luminescent polypeptide variants showed elevated background luminescence.

Example 31

Figure 48:
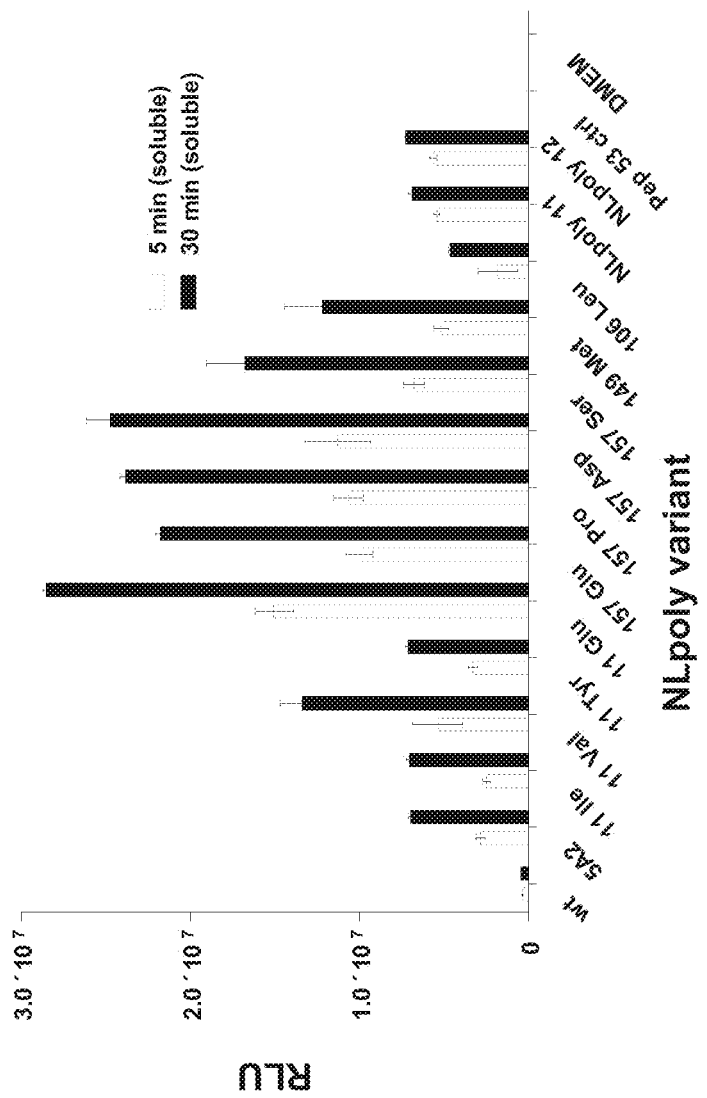
FIG. 48 shows a graph of background luminescence of various NLpoly variants.

Luminescence of Additional Non-Luminescent Polypeptide Variants after Complementation Luminescence of the additional non-luminescent polypeptide variants generated in Example 28 was measured by incubating 25 µl of non-luminescent polypeptide variant lysate with 25 µl NLpep-53 at room temperature for 10 minutes 50 µl NANOGLO Luciferase Assay Reagent was then added, and luminescence measured at 5 and 30 minutes on a Tecan Infinite F500. NLpep53 (Pep 53) alone and DMEM (DMEM) alone were used as controls. FIG. 48 demonstrates that the non-luminescent polypeptide variants Val-11, Glu-11, Glu-157, Pro-157, Asp-157. Ser-157 and Met-149 generated significantly more luminescence than parental 5A2.

Example 32

Correlation Between Increased Background Luminescence of Non-Luminescent Polypeptide in the Absence of Non-Luminescent Peptide and Amount of Protein in Soluble Fraction Individual colonies of the non-luminescent polypeptide variants 3P, 3E, 5P, 5E, 6P and 6E were picked and grown overnight in LB+ampicillin at 30° C. and then diluted 1:100 in LB+ampicillin and grown at 37° C. for 2.5 hours (OD600 ~0.5). Rhamnose was added to a final concentration of 0.2%, and the cells were split in triplicate and grown overnight at 25° C. for 18 h. Cells were lysed using 0.5× Fast Break for 30 minutes at ambient temperature, snap-frozen on dry ice, and stored at –20° C. Upon fast thawing, soluble fractions were prepared by centrifugation at 10K for 15 min at 4° C. Samples were assayed for luminescence on a Tecan Infinite F-500. FIG. 50A shows the total lysate and soluble fraction of each non-luminescent polypeptide variant. FIG. 50B shows the background luminescence of each non-luminescent polypeptide variant. FIG. 51 shows the luminescence generated with each non-luminescent polypeptide variant when complemented with 10 or 100 nM NLpep78 (NVS-GWRLFKKISN) in LB medium.

Example 33

Elongations and Deletions of Non-Luminescent Polypeptide

Figure 52:
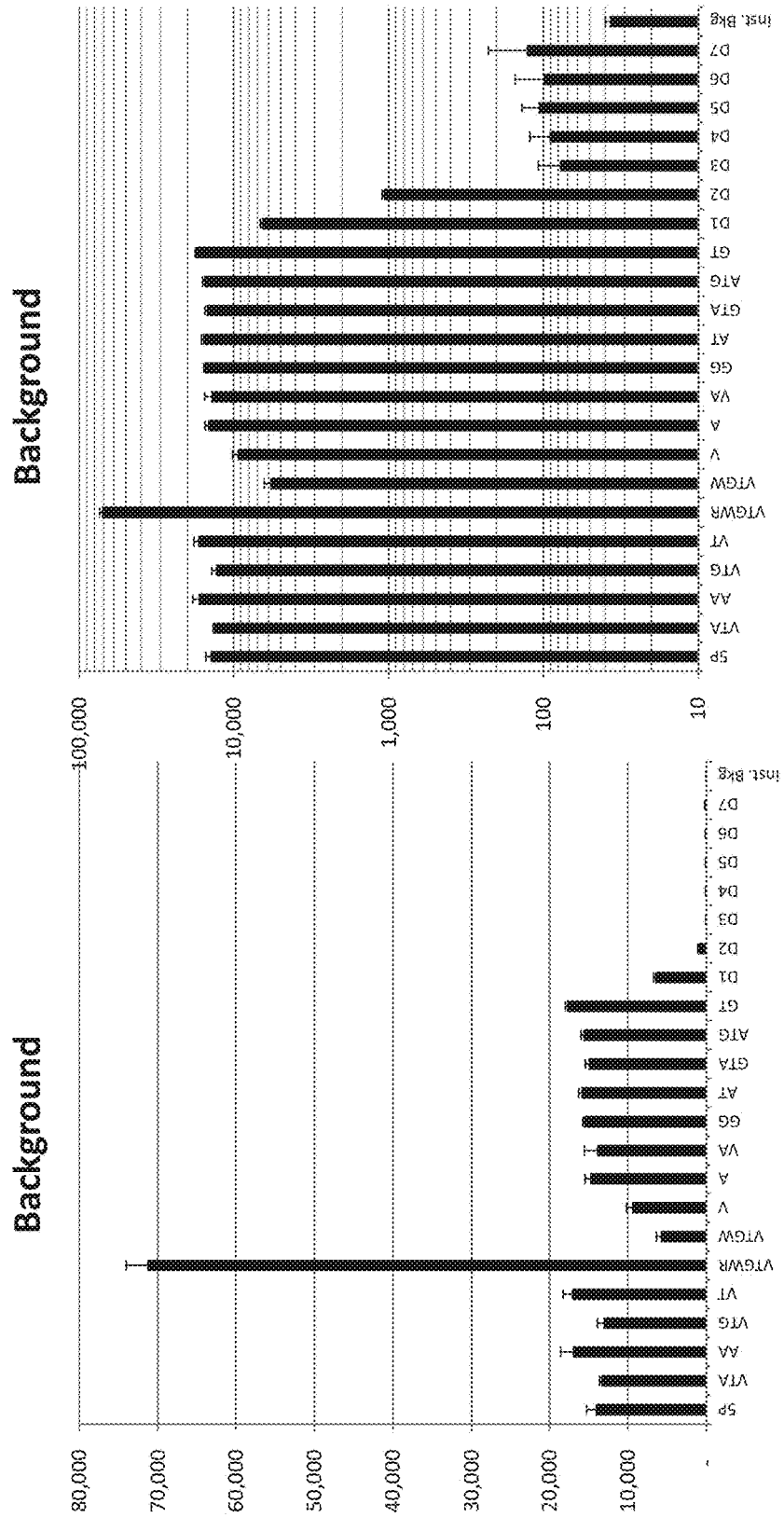
FIG. 52 shows graphs depicting background luminescence in *E. coli* lysate of various NLpoly variants.
Figure 53:
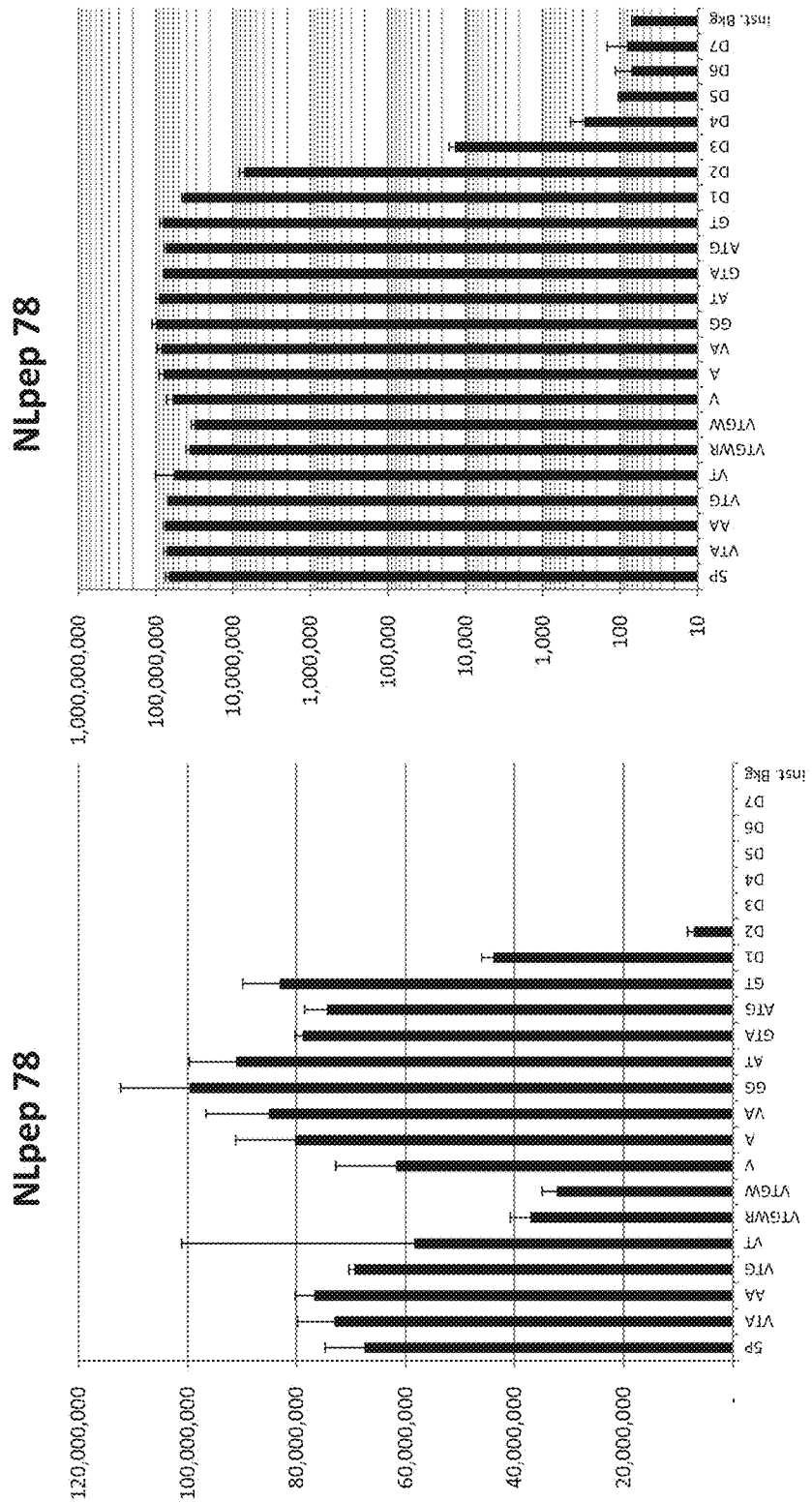
FIG. 53 shows graphs depicting luminescence in *E. coli* lysate of various NLpoly variants complemented with NLpep78.
Figure 54:
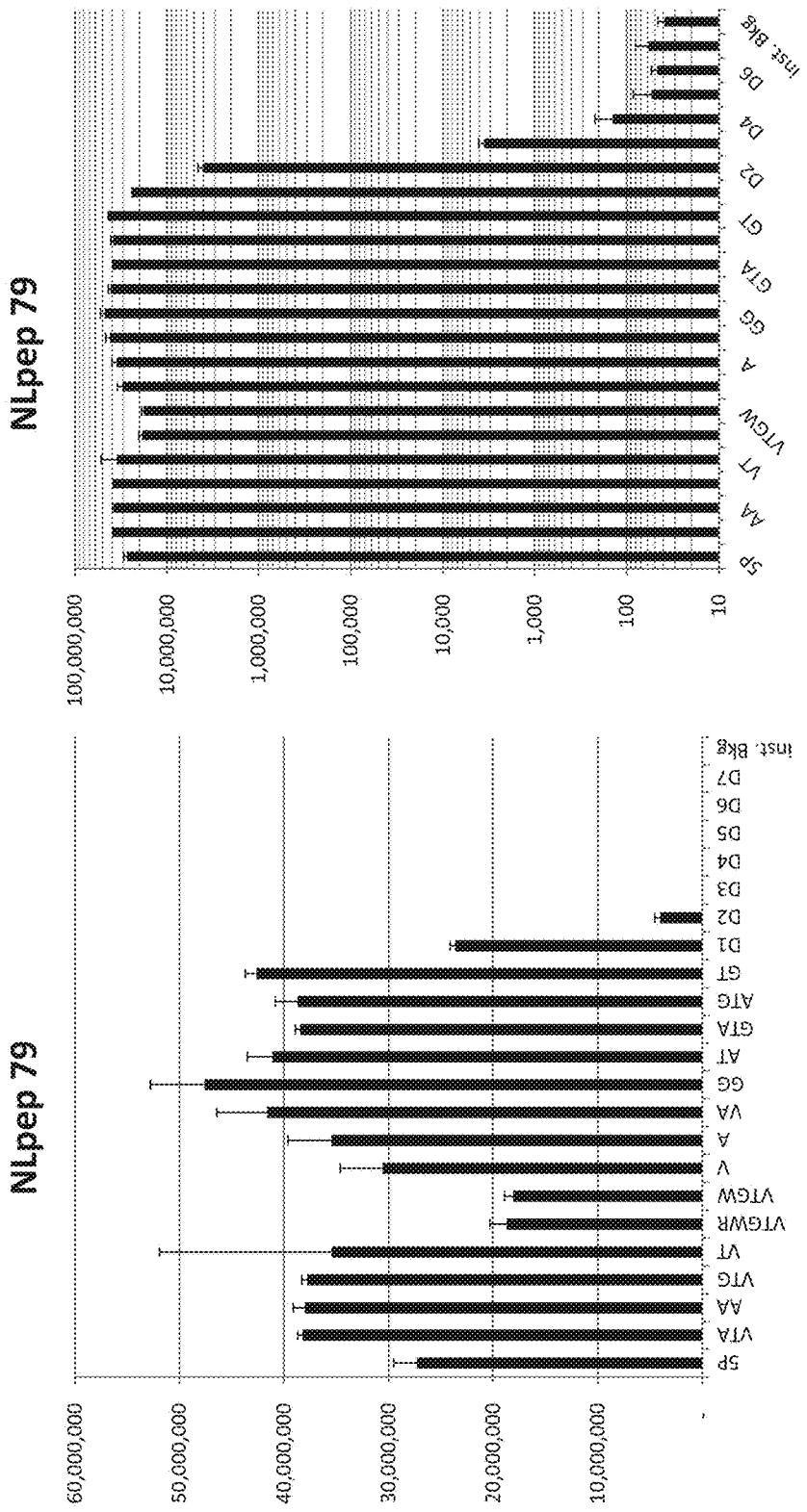
FIG. 54 shows graphs depicting luminescence in *E. coli* lysate of various NLpoly variants complemented with NLpep79.
Figure 55:
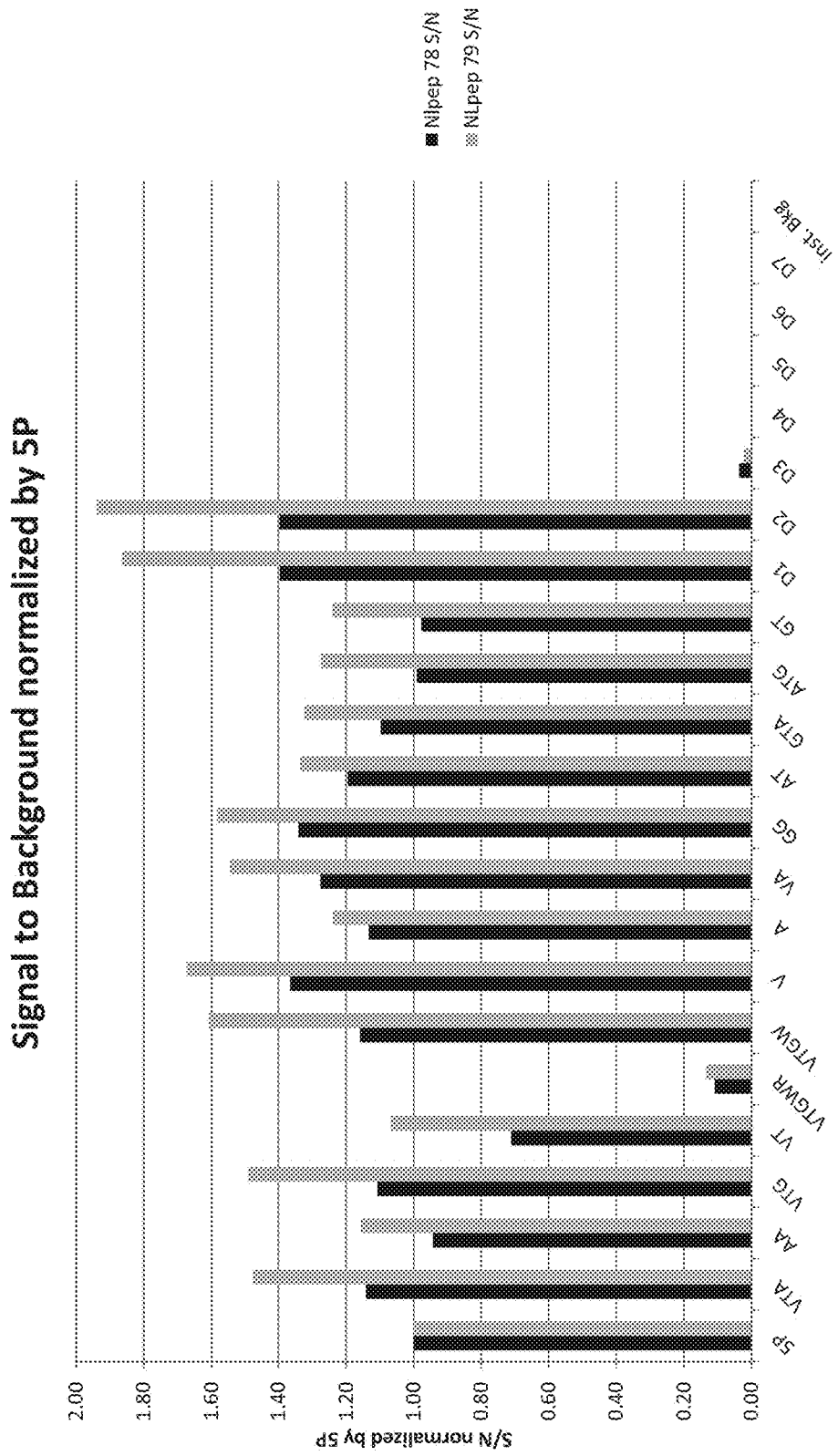
FIG. 55 shows a graph of signal to background of various NLPolys variants complemented with NLpep78 or NLpep79 and normalized to NLpoly 5P.
Figure 56:
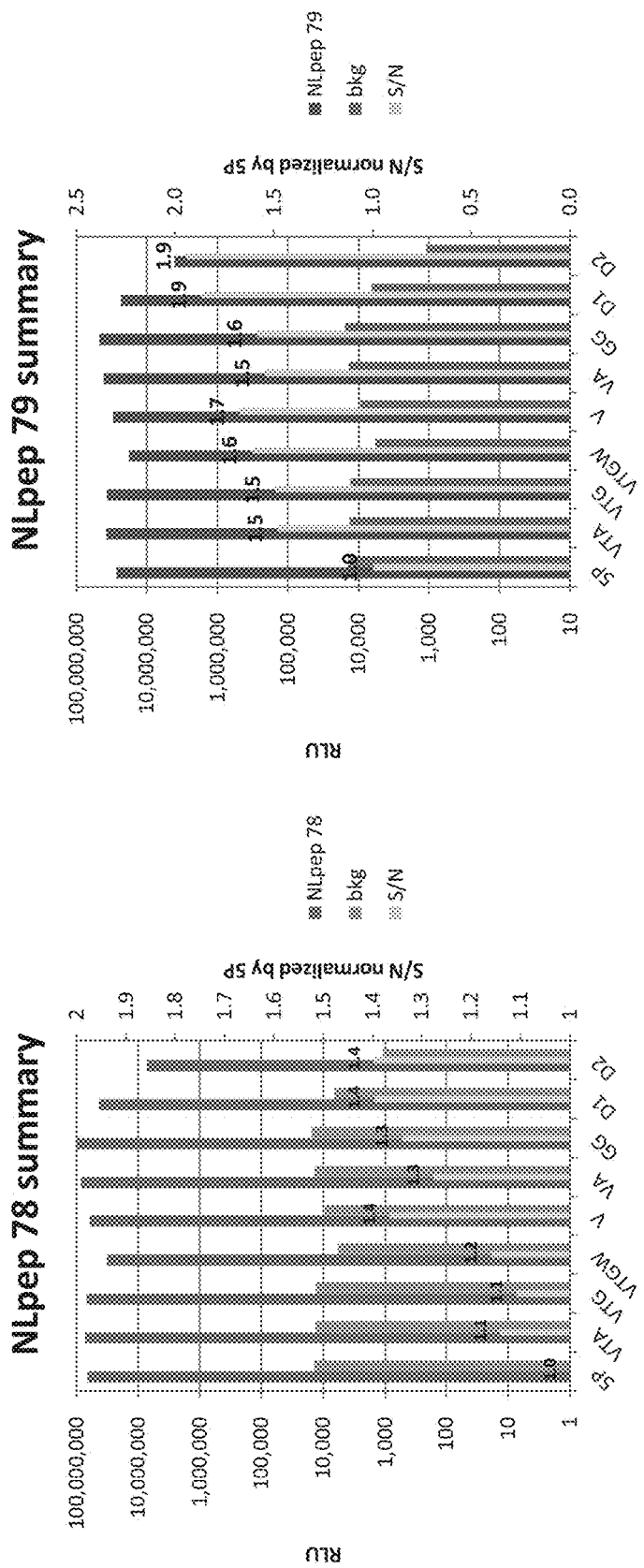
FIG. 56 shows a graph depicting background, luminescence with NLpep79 (right) or NLpep78 (left) and signal-to-noise or various NLpoly variants.
Figure 57:
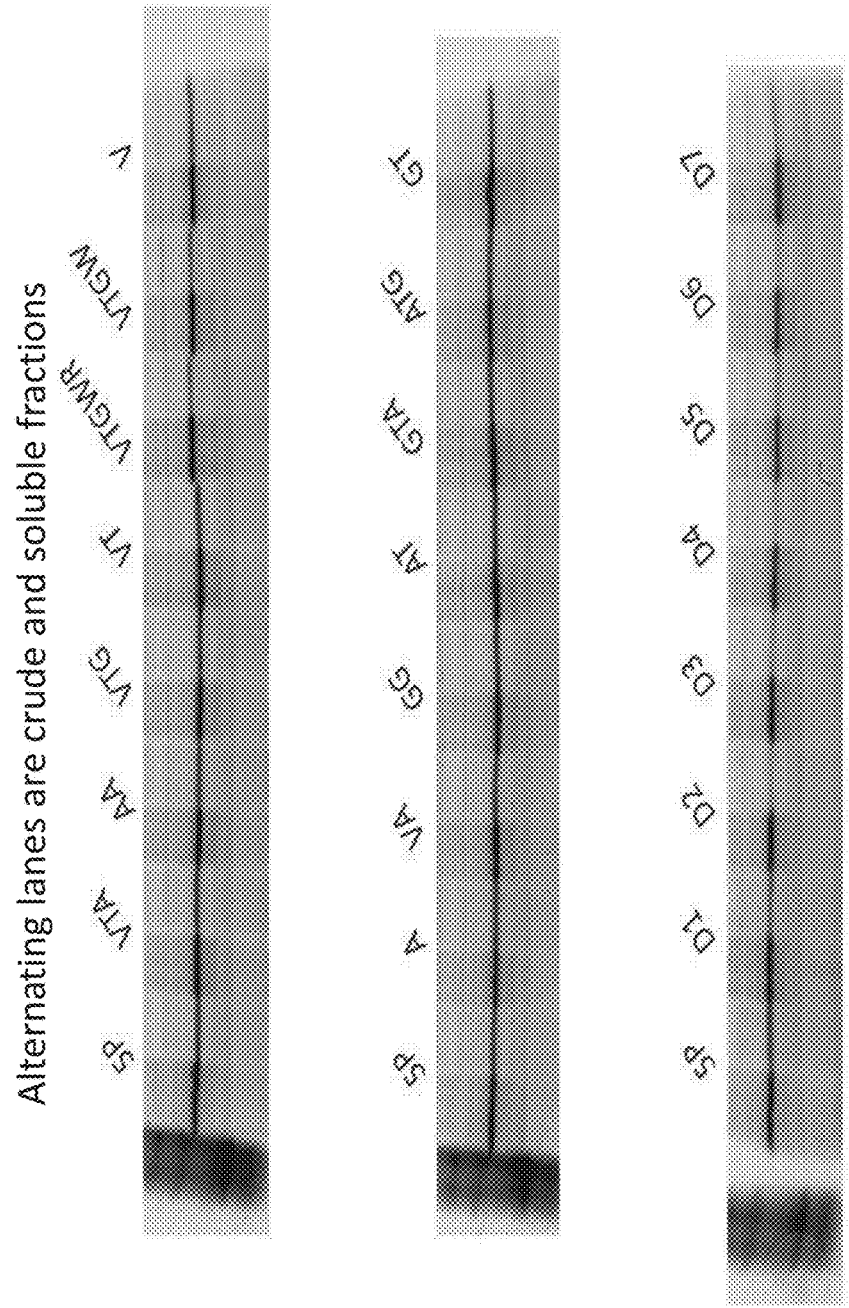
FIG. 57 shows a SDS-PAGE gel of the total lysate and soluble fraction in various NLpoly 5P variants.

The non-luminescent polypeptide variant 5P was either elongated at the C-terminus by the addition of the residues VAT, AA, VT(VT, VTGWR (SEQ ID NO: 2576), VTGW (SEQ ID NO: 2577). V, A, VA, GG AT, GTA, ATG or GT or deletion of 1 to 7 residues at the C-terminus of 5P, e.g., D1=deletion of I residue, D2=deletion of 2 residues, etc. Background luminescence in *E. coli* lysates (FIG. 52) and luminescence generated after complementation with NLpep78 (FIG. 53; NVSGWRLFKKISN (SEQ ID NO: 374)) or NLpep79 (FIG. 54; NVTGYRLFKKISN (SEQ ID NO: 376)) were measured. FIG. 55 shows the signal-to-background of the non-luminescent polypeptide 5P variants. FIG. 56 provides a summary of the luminescent results. FIG. 57 shows the amount of total lysate and soluble fraction in each non-luminescent polypeptide 5P variant.

Example 34

Comparison of 5P and 1107L Non-Luminescent Polypeptide Variant

Figure 58:
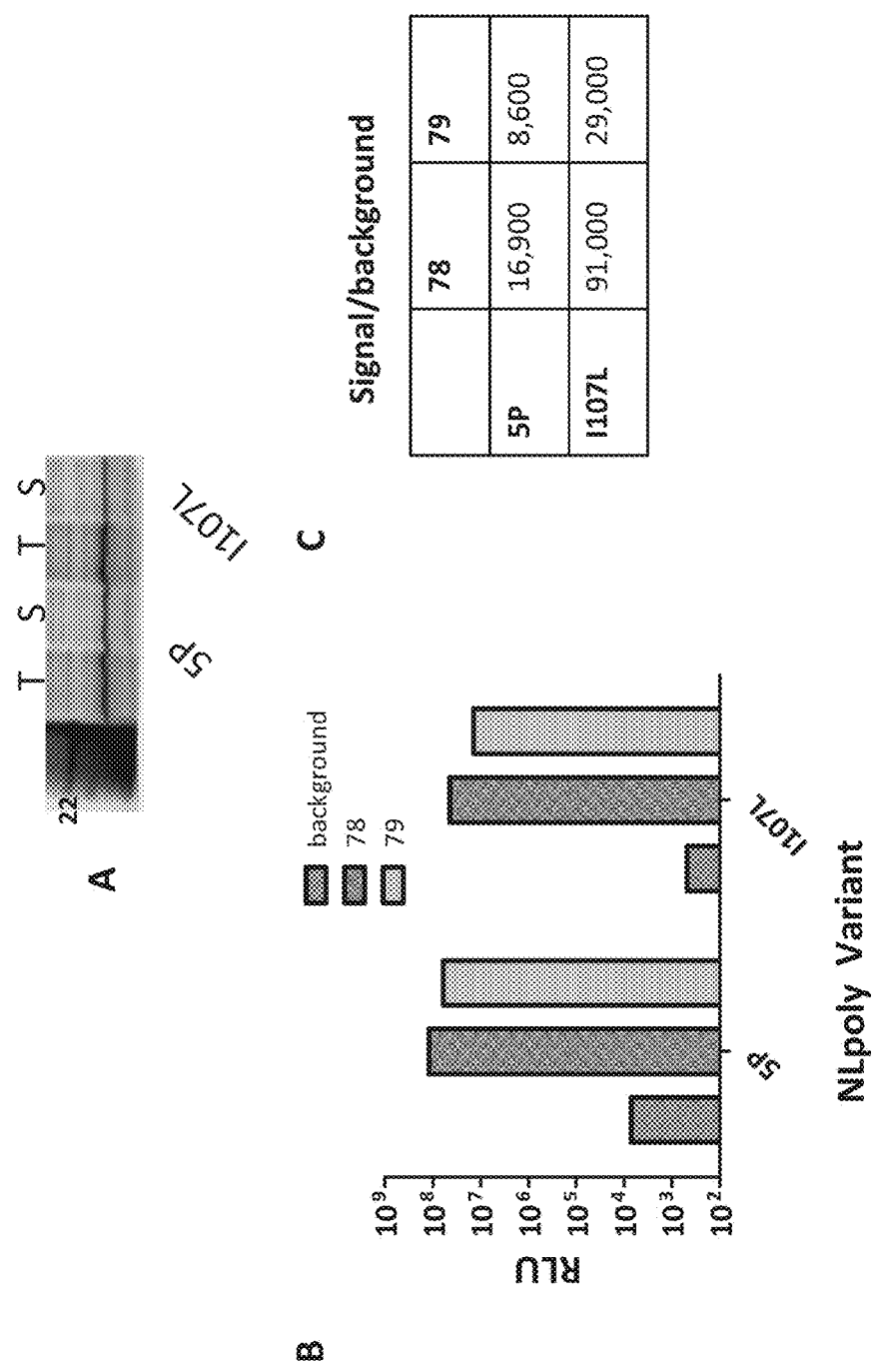
FIG. 58 shows (A) the amount of total lysate and soluble fraction of NLpoly 5P and NLpoly I1107L. (B) luminescence generated by NLpoly 5P or NLpoly I1107L without NLpep or with NLpep78 or NLpep79 and (C) the improved signal-to-background of NLpoly1107L over NLpoly 5P.
Figure 59:
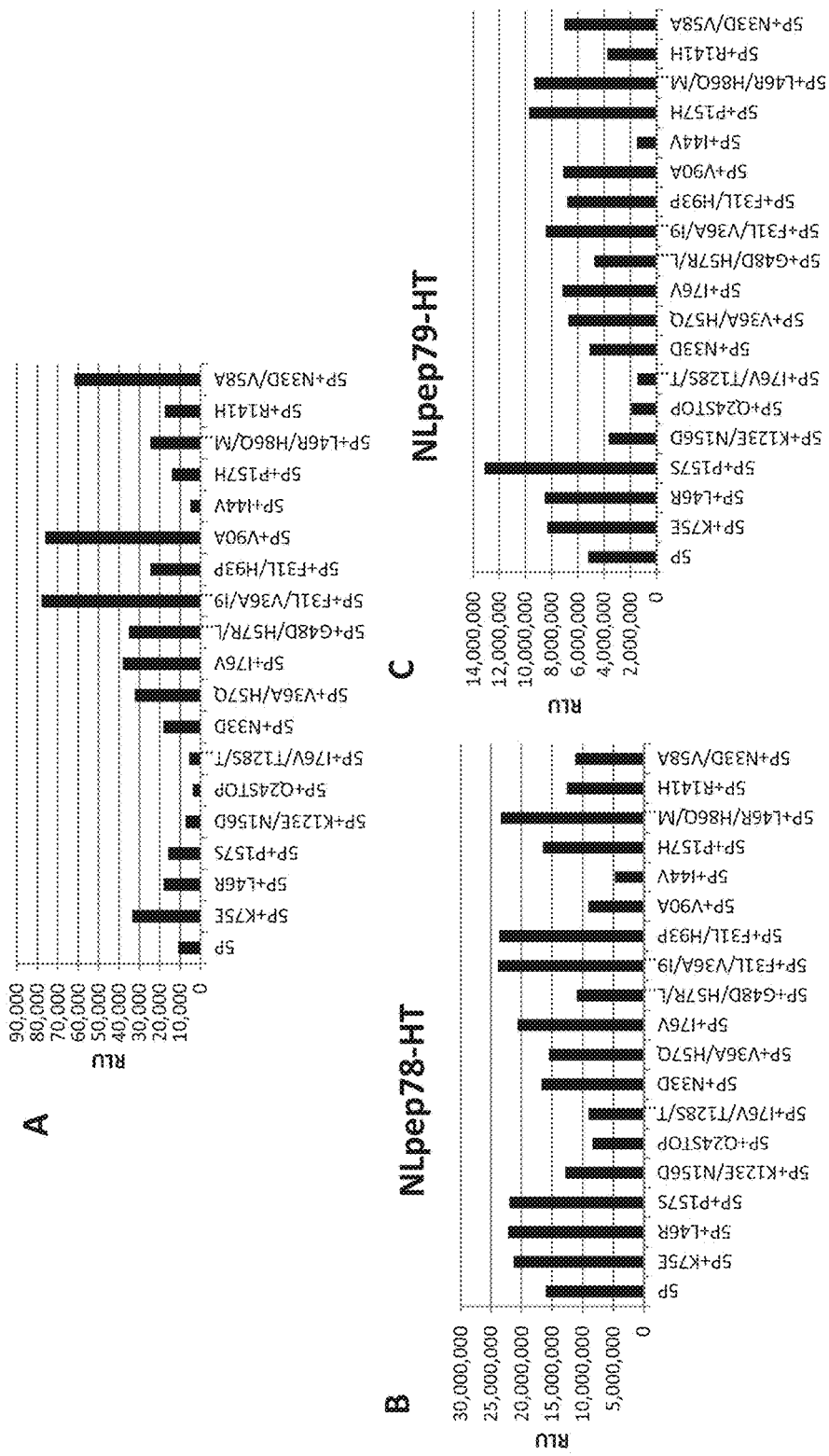
FIG. 59 shows graphs of luminescence for various NLpoly variants (A) without complementary peptide, (B) with NLpep78-HT and (C) with NLpep79-HT.
Figure 60:
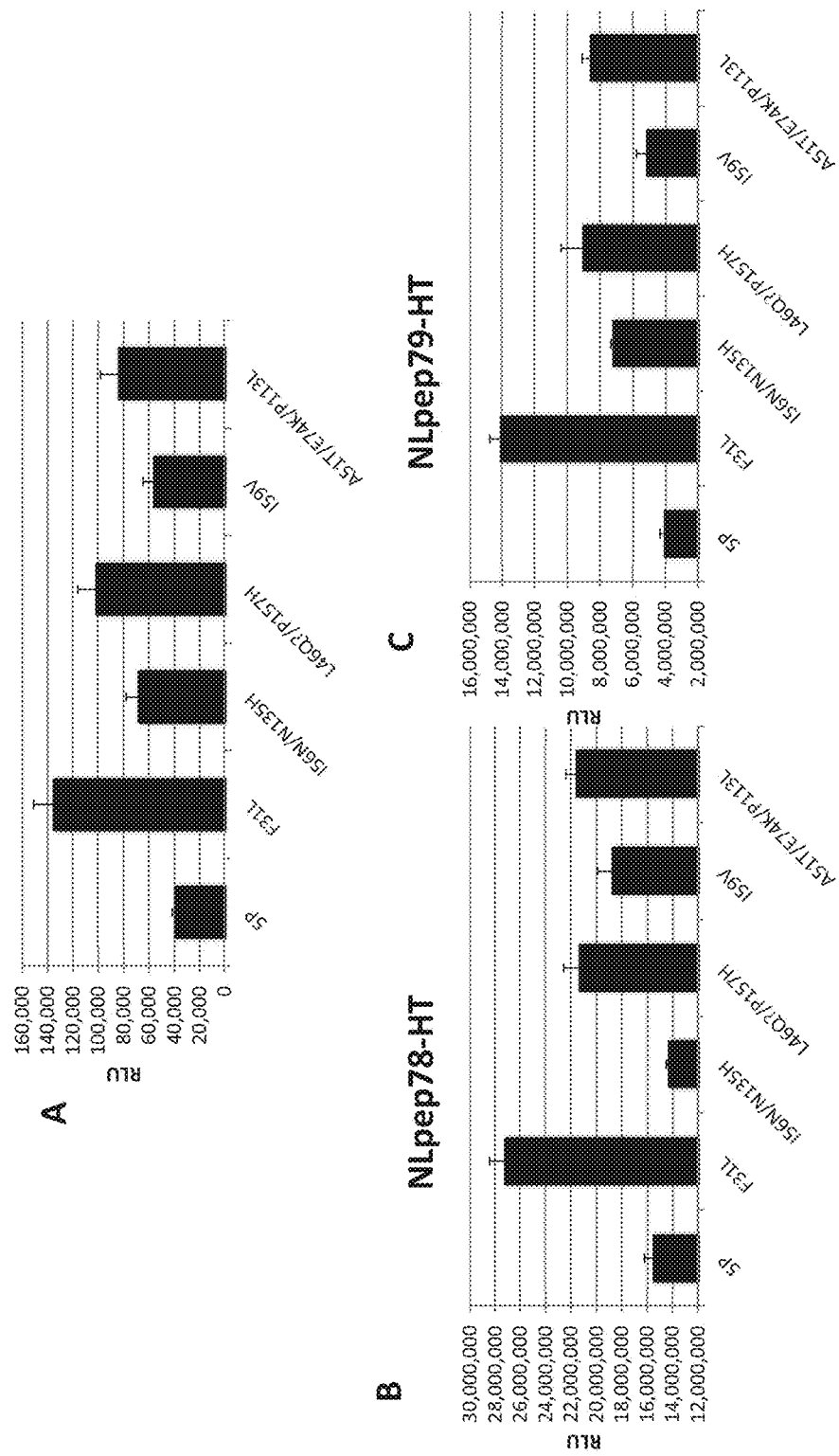
FIG. 60 shows graphs of luminescence for various NLpoly variants (A) without complementary peptide, (B) with NLpep78-HT and (C) with NLpep79-HT.
Figure 61:
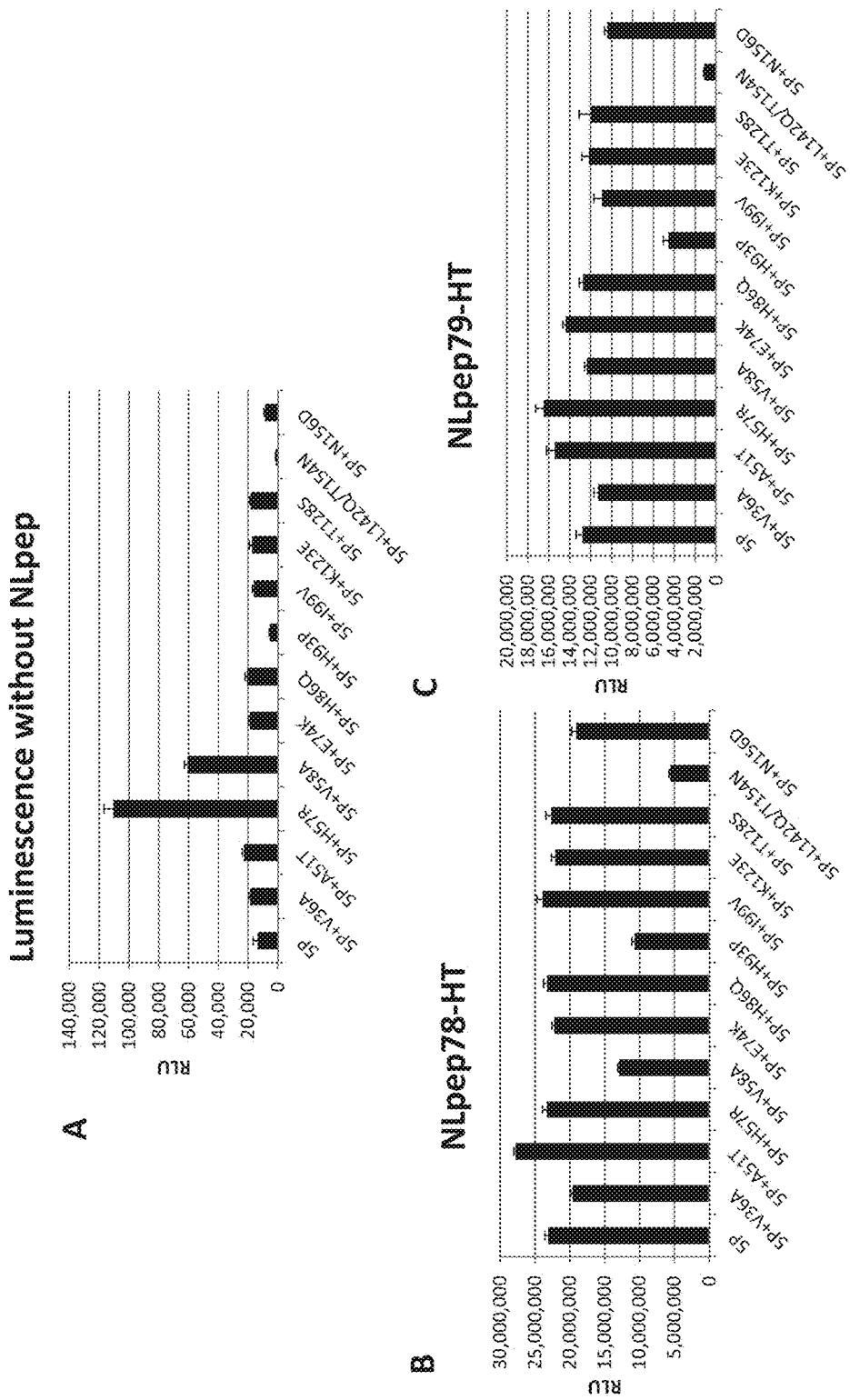
FIG. 61 shows graphs of luminescence for various NLpoly variants (A) without complementary peptide, (B) with NLpep78-HT and (C) with NLpep79-HT.
Figure 62:
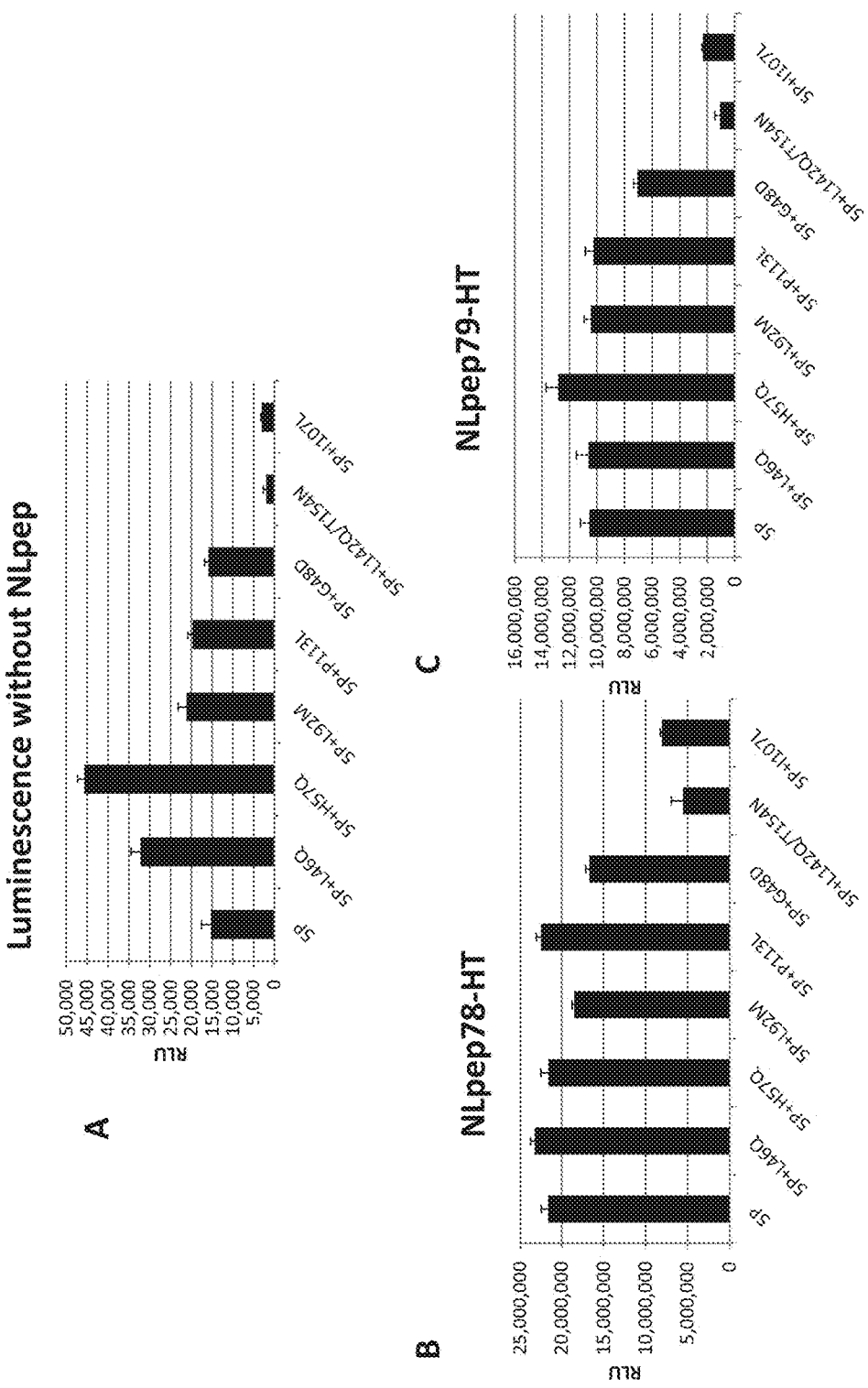
FIG. 62 shows graphs of luminescence for various NLpoly variants (A) without complementary peptide, (B) with NLpep78-HT and (C) with NLpep79-HT.

FIG. 58 shows the amount of total lysate and soluble fraction of 5P and 1107L (A), luminescence generated by 5P or 1107L without non-luminescent peptide or with NLpep78 or NLpep79 (B) and the improved signal-to-background of 1107L over 5P (C).

Example 35

Generation of 5P Non-Luminescent Polypeptide Mutants

Mutations identified in a screening of random mutations in the 5P non-luminescent polypeptide variant were generated as previously described. Each single 5P non-luminescent polypeptide mutant colony was inoculated in 200 µl Minimal Media and incubated with shaking at 37° C. for 20 hours. 10 µl of the culture was then added to 190 µl of fresh Minimal Media and incubated again with shaking at 37° C. for 20 hours. 10 µl of the second culture was then added to 190 µl Auto-Induction Media (Minimal Media+5% glucose+2% rhamnose) and incubated with shaking at 25° C. for 18 hours to allow expression of the non-luminescent polypeptide mutant. 10 µl of the 5P non-luminescent polypeptide mutant expression culture was added to 40 µl of assay lysis buffer containing NLpep78-HT (1:386 dilution) or NLpep79-HT (1:1,000 dilution) and shaken at room temperature for 10 minutes. 50 µl of NANOGLO Assay Buffer containing 100 uM coelenterazine was added and shaken at room temperature for 10 minutes. Luminescence was measured on GLOMAX with 0.5 sec integration. FIGS. 59-62A shows background luminescence while FIGS. 59-62B and C show luminescence generated after complementation with NLpep78 or NLpep79.

Example 36

Figure 63:
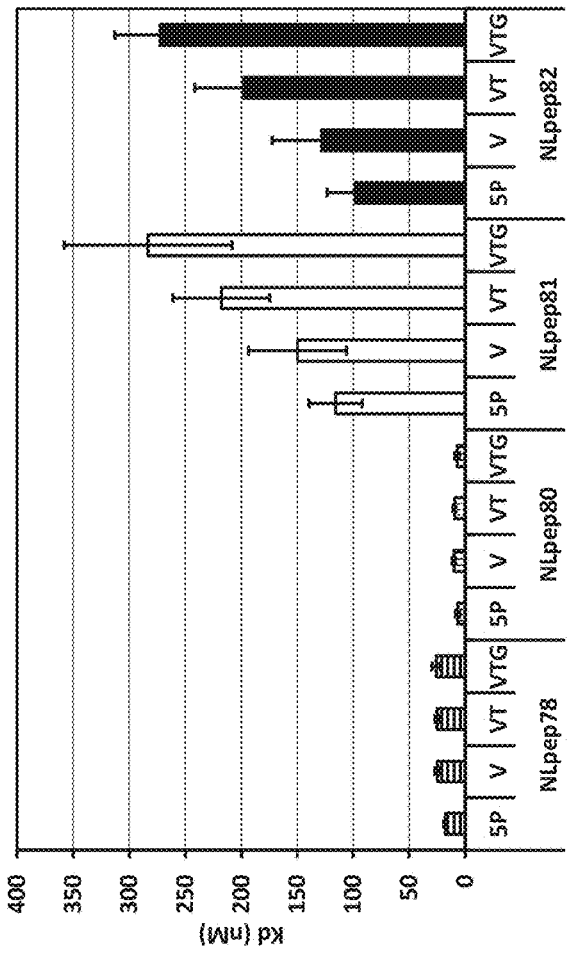
FIG. 63 shows binding affinity between an elongated NLpoly variant (additional amino acids at the C-terminus) and a shortened NLpep (deleted amino acids at the N-terminus).

Binding Affinity Between Elongated Non-Luminescent Polypeptide Variant and Deleted Non-Luminescent Peptide The binding affinity between an elongated non-luminescent polypeptide variant, i.e., containing additional amino acids at the C-terminus, and a deleted non-luminescent peptide, i.e., deleted amino acids at the N-terminus.
Lysates of E. coli expressing non-luminescent polypeptide 5P/+V/+VT/+VTG prepared as previously described were diluted 1:2000 in PBS+0.1% PRIONEX. 25 µl of the diluted lysate was incubated with 25 µl of NLpep78, NLpep80, NLpep81 or NLpep82 (diluted 0-500 nM in dilution buffer) for 5 min at room temp. 50 µl of Furimazine diluted to 1× with NANOGLO Assay Buffer was added to each sample and incubated for 10 minutes at room temperature. Luminescence was measured on a GLOMAX Multi with 0.5 s integration time. FIG. 63 demonstrates the binding affinity between NLpolys with additional amino acids at the C-terminus with NLpeps with amino acids deleted from the N-terminus.

Example 37

Figure 64:
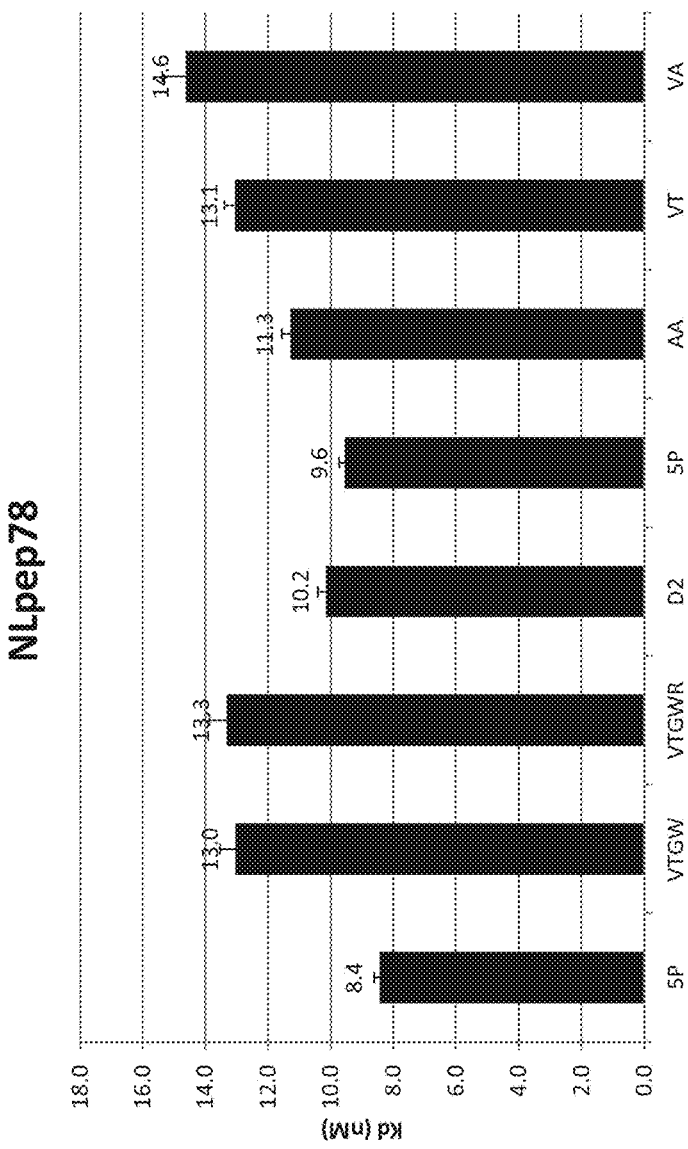
FIG. 64 shows a graph of binding affinity of various NLpoly variants with NLpep78.

Binding Affinity Between Non-Luminescent Polypeptide Expressed in E. coli and Synthetic Non-Luminescent Peptide Non-luminescent polypeptide LB lysates were prepared and diluted 1:100 into PBS+0.1% PRIONEX. 2× dilutions of synthetic NLpep78 were made in PBS+0.1% PRIONEX. 25 µl of the diluted non-luminescent polypeptide lysate was mixed with 25 µl of each dilution of non-luminescent peptide and incubated 3 minutes at ambient temperature. 50 µl of NANOGLO Luciferase Assay Reagent was added, incubated for 5 minutes at room temperature, and luminescence measured on a GLOMAX Multi+. FIG. 64 shows the calculated Kd values using one-site specific binding.

Example 38

Binding Affinity Between 5P Non-Luminescent Polypeptide Expressed in Mammalian Cells and NLpep80 or NLpep87

Figure 65:
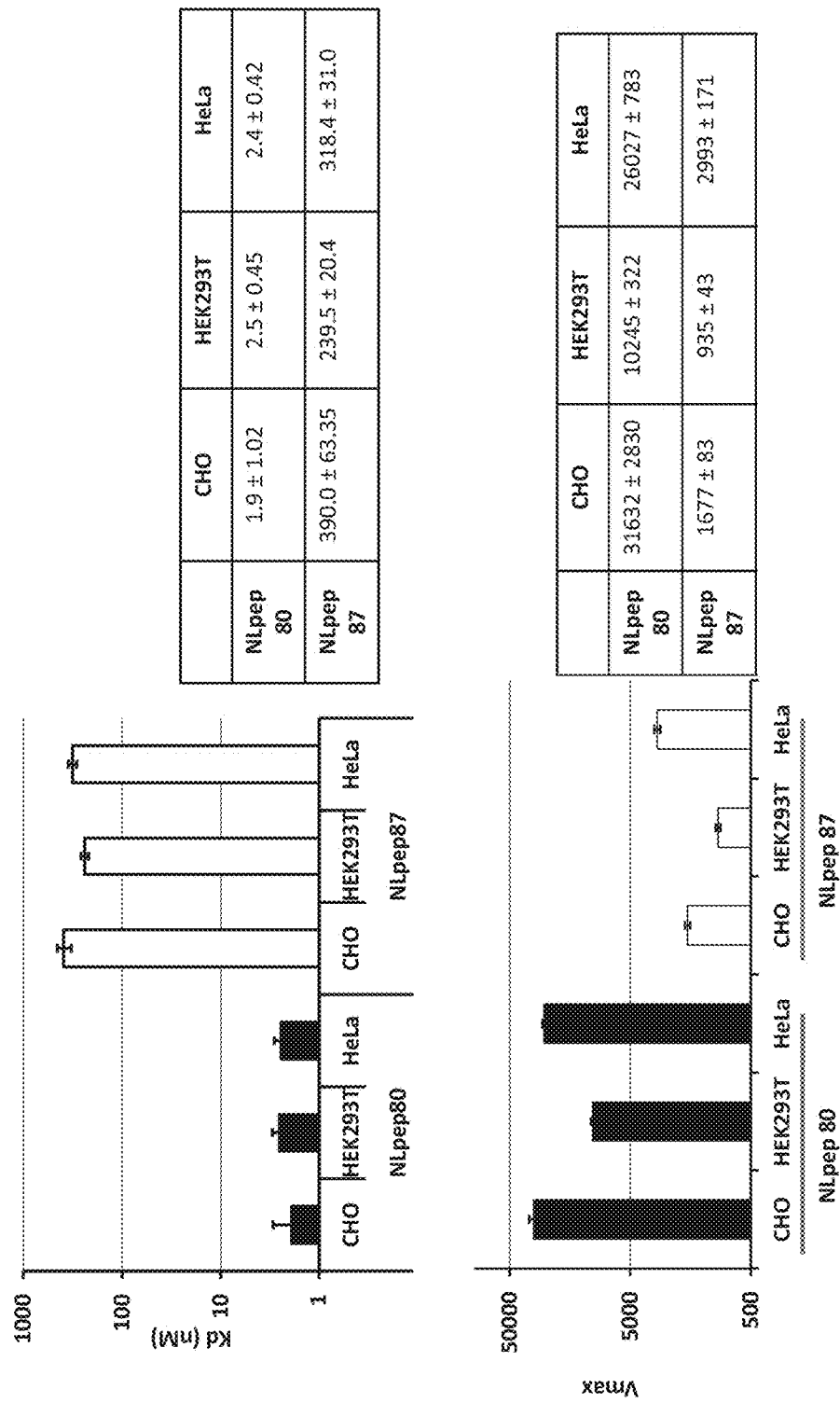
FIG. 65 shows the binding and Vmax of NLpep80 and NLpep87 to 5P expressed in mammalian cells (CHO, HEK293T and HeLa).

Lysates of CHO, HEK293T. or HeLa cells expressing NLpoly 5P were diluted 1:1000 in dilution buffer (PBS+0.1% PRIONEX) 25 µl of diluted lysate was incubated with 25 µl of NLpep80/87 (diluted 0-5 µM in dilution buffer) for 5 min at room temp. 50 µl of furimazine (diluted to 1× with NANOGLO buffer) was added to each well, and the plate was incubated for 10 min at room temp. Luminescence was then read on a GLOMAX Multi with 0.5 s integration time (FIG. 65).

Example 39

Binding Affinity Between 5P Non-Luminescent Polypeptide Expressed in E. coli and NLpep80 or NLpep87

Figure 66:
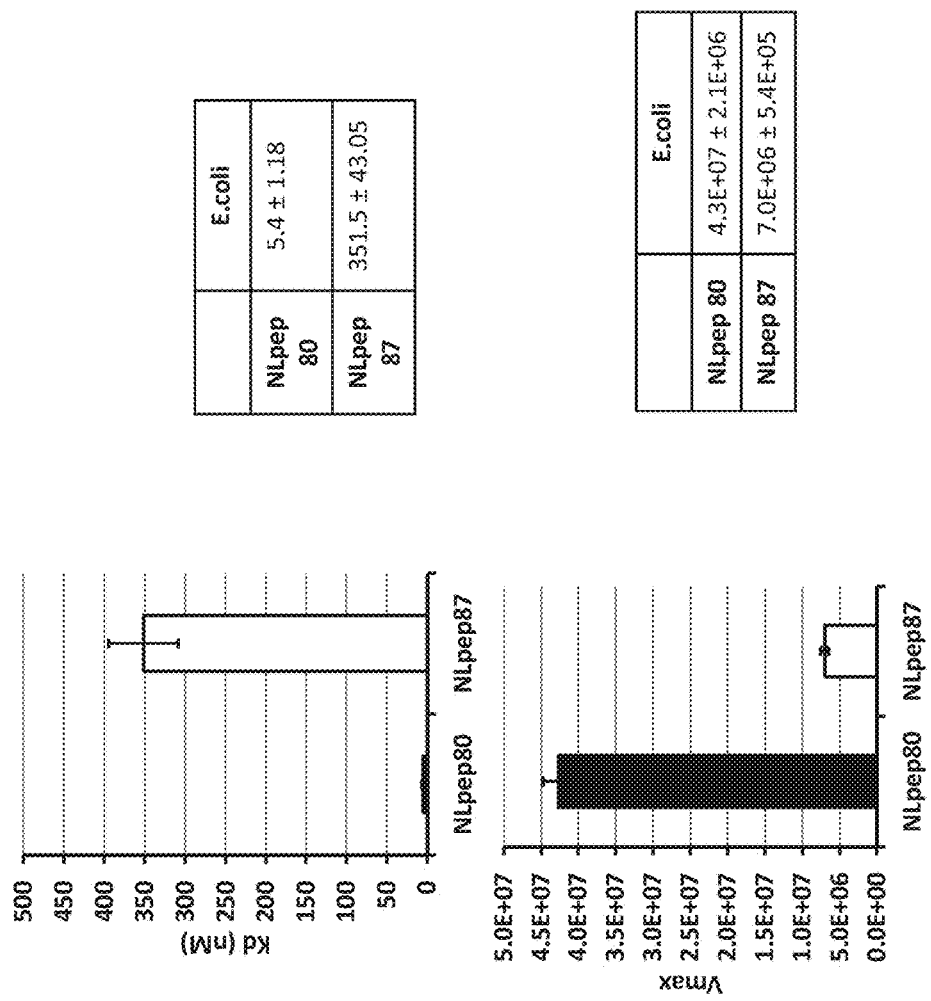
FIG. 66 shows the binding and Vmax of NLpep80 and NLpep87 to NLpoly 5P expressed in *E. coli*.

Lysates of E. coli expressing NLpoly 5P were diluted 1:2000 in dilution buffer (PBS+0.1% PRIONEX) 25 µl of diluted lysate was incubated with 25 µl of NLpep80/87 (diluted 0-5 µM in dilution buffer) for 5 min at room temp. 50 µl of furimazine (diluted to 1× with NANOGLO buffer) was added to each well, and the plate was incubated for 10 min at room temp. Luminescence was then read on a GLOMAX Multi with 0.5 s integration time (FIG. 66).

Example 40

Figure 67:
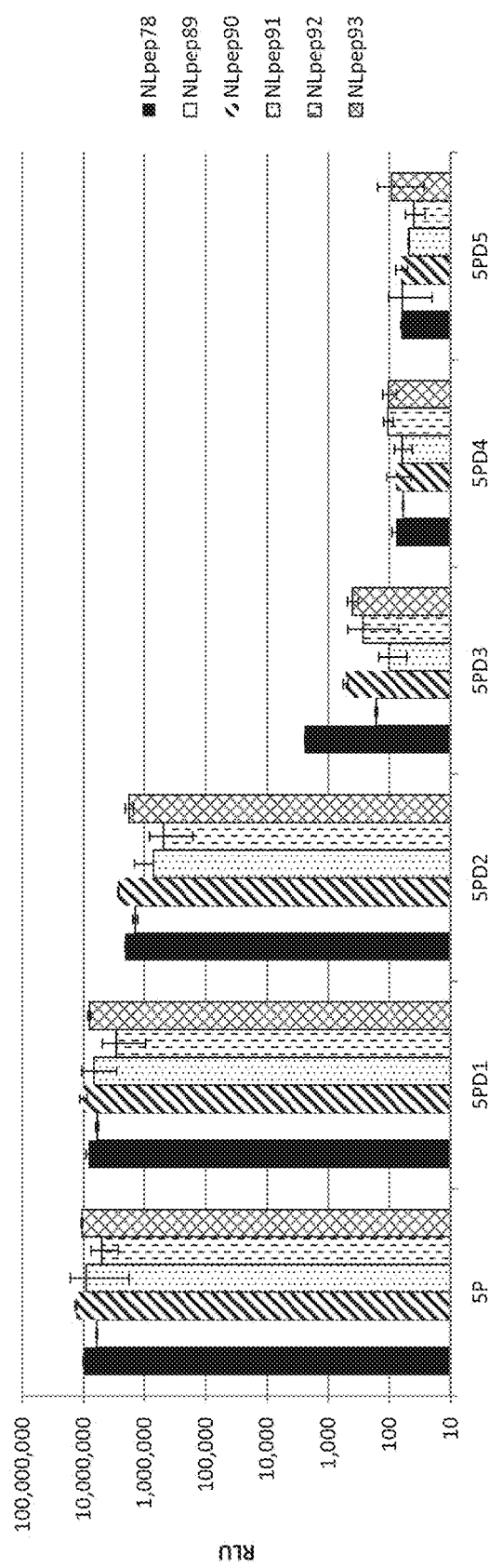
FIG. 67 shows a graph of luminescence of shortened NLpolys with elongated NLpeps.

Complementation Between a Deleted Non-Luminescent Polypeptide and Elongated Non-Luminescent Peptide Complementation between a deleted non-luminescent polypeptide, i.e., amino acids deleted from the C-terminus, and an elongated non-luminescent peptide, i.e., amino acids added to the N-terminus, was performed. NLpep-HT E. coli clarified lysates as prepared as previously described in Example 6. The amount of NLpep-HT was quantitated via the HALOTAG fusion. Briefly, 10 µl of clarified lysate was mixed with 10 µl HALOTAG-TMR ligand (diluted 1:100) and 80 µl water and incubated at room temperature for 10 minutes. 33.3 µl 4×SDS Loading Buffer was added and incubated at 95° C. for 5 minutes. 15 µl was loaded onto an SDS-PAGE gel and imaged on a Typhoon. Based on the intensities from the SDS-PAGE gel, non-luminescent peptides were diluted in PBS+0.1% PRIONEX non-luminescent peptides to make equivalent concentrations. The non-luminescent polypeptide lysates were then diluted 1:100 in PBS+0.1% PRIONEX. 20 µl of diluted non-luminescent polypeptide and 20 µl diluted non-luminescent peptide were mixed and shaken at room temperature for 10 minutes. 40 µl NANOGLO Luciferase Assay Reagent was added and shaken at room temperature for 10 minutes. Luminescence was measured on a GLOMAX using 0.5 sec integration. FIG. 67 demonstrates the luminescence of NLpolys with amino acids removed from the C-terminus with NLpeps with additional amino acids on the N-terminus.

Example 41

Binding Affinity Between 5P Non-Luminescent Polypeptide Expressed in Hela Cells and NLpep78 or Truncated NLpep78 (NLpep80-87)

Figure 68:
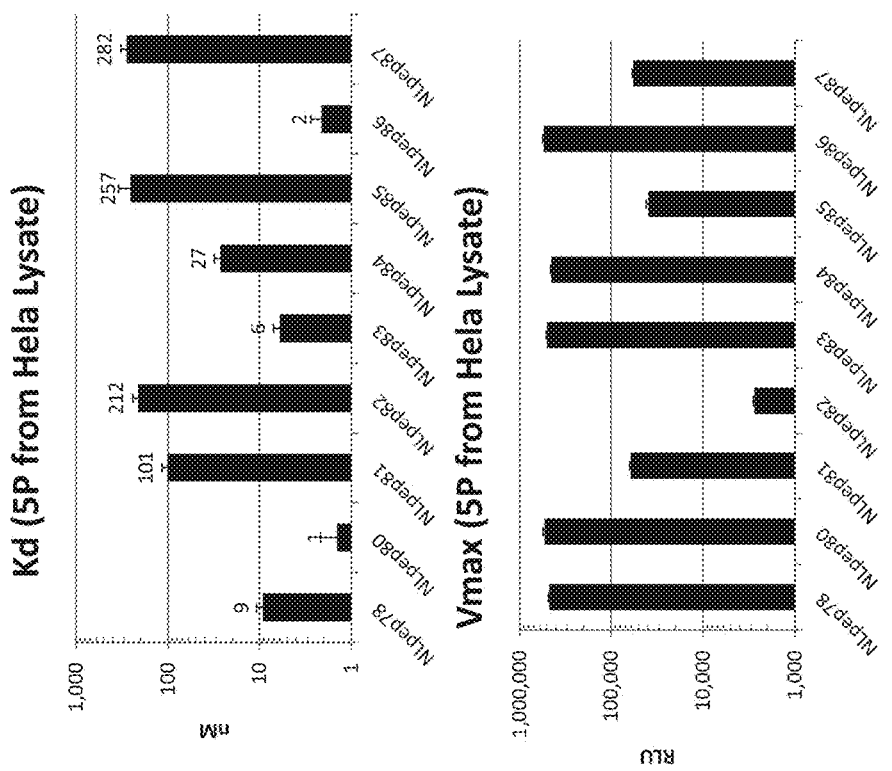
FIG. 68 shows graphs of Kd and Vmax of NLpoly 5P in HeLa lysate with various complementary NLpeps.

5P non-luminescent polypeptide lysate was prepared from Hela cells as previously described and diluted prepared 1:10 in PBS+0.1% PRIONEX. 4×concentrations (range determined in preliminary titration experiment) of non-luminescent peptide (synthetic peptide; by Peptide 2.0 (Virginia); made at either 5, 10, or 20 mg scale; blocked at the ends by acetylation and amidation, and verified by net peptide content analysis) was prepared in PBS+0.1% PRIONEX. 20 µl 5P non-luminescent polypeptide and 20 µl non-luminescent peptide were mixed and shaken at room temperature for 10 minutes. 40 µl of NANOGLO Luciferase Assay reagent was added and shaken at room temperature for 10 minutes. Luminescence was measured on GLOMAX with 0.5 s integration. FIG. 68 demonstrates the binding affinity and corresponding luminescence between 5P and truncated versions of NLpep78. The binding affinity is increased when 1 amino acid is removed from the N-terminus, the C-terminus, or 1 amino acid from each terminus. Removing more than 1 amino acid from either terminus lowers the affinity but does not always lower the Vmax to the same extent.

Example 42

Binding Affinity Between Elongated Non-Luminescent Polypeptide and Truncated Non-Luminescent Peptide The binding affinity between an elongated non-luminescent polypeptide, i.e., one with 2 extra amino acids on C-terminus, and a truncated non-luminescent peptide, i.e., one with 2 amino acids removed from N-terminus (NLpep81), was determined.

Figure 69:
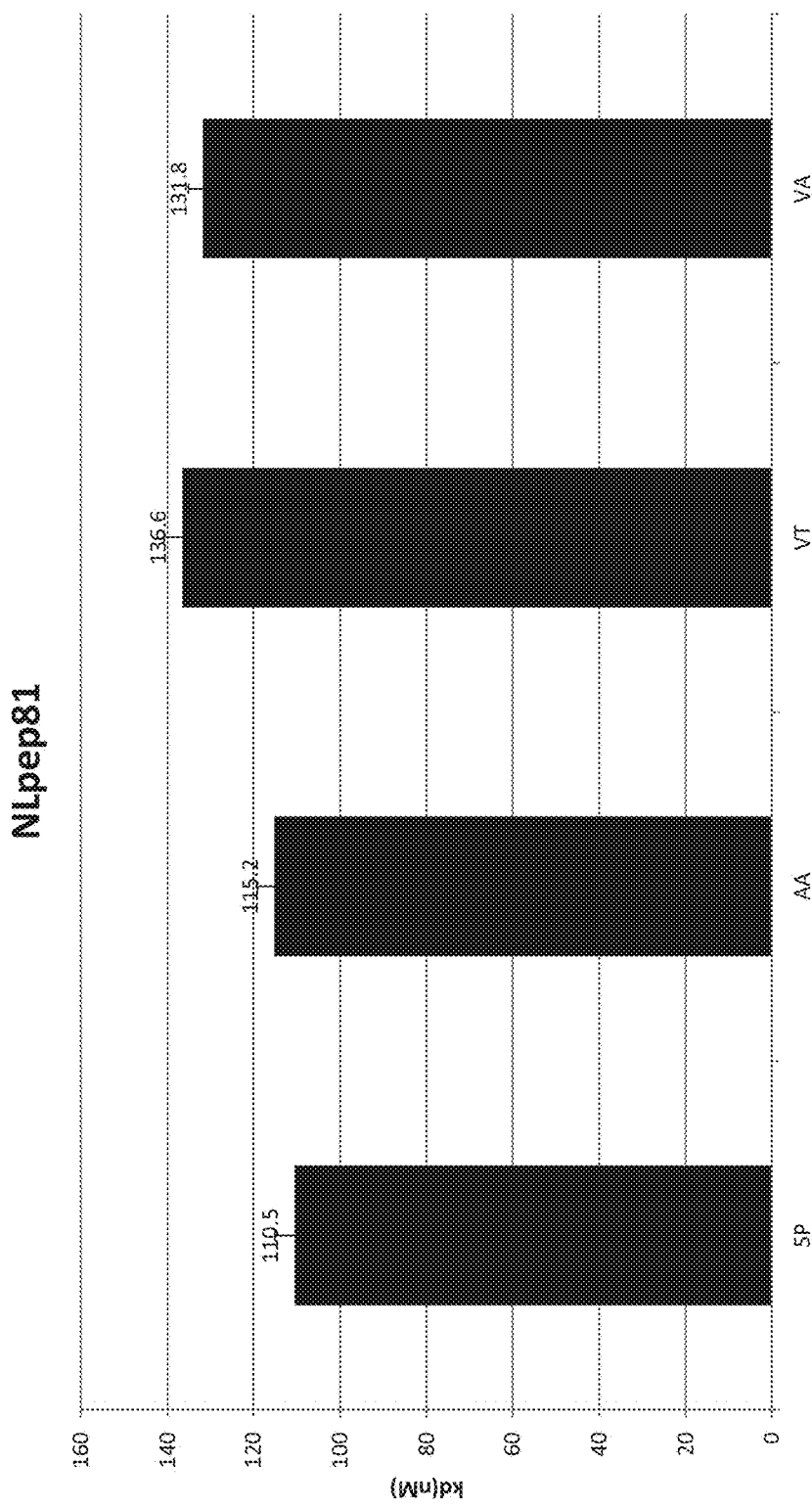
FIG. 69 shows a graph of binding affinities for several NLpoly variants with NLpep81.

Non-luminescent polypeptide lysate was prepared as previously described and diluted prepared 1:100 in PBS+0.1% PRIONEX. 2× dilutions of NLpep81 (synthetic peptide; by Peptide 2.0 (Virginia); made at either 5, 10, or 20 mg scale; blocked at the ends by acetylation and amidation, and verified by net peptide content analysis) was prepared in PBS+0.1% PRIONEX. 25 µl non-luminescent polypeptide and 25 µl of each non-luminescent peptide dilution were mixed and shaken at room temperature for 3 minutes. 50 µl of NANOGLO Luciferase Assay reagent was added and shaken at room temperature for 5 minutes. Luminescence was measured on GLOMAX with 0.5 s integration. FIG. 69 shows the calculate Kd values using one-site specific binding.

Example 43

Binding Affinity Between Elongated Non-Luminescent Polypeptide and Truncated Non-Luminescent Peptide The binding affinity between an elongated non-luminescent polypeptide, i.e., one with 3 extra amino acids on C-terminus, and a truncated non-luminescent peptide, i.e., one with 3 amino acids removed from N-terminus (NLpep82), was determined.

Figure 70:
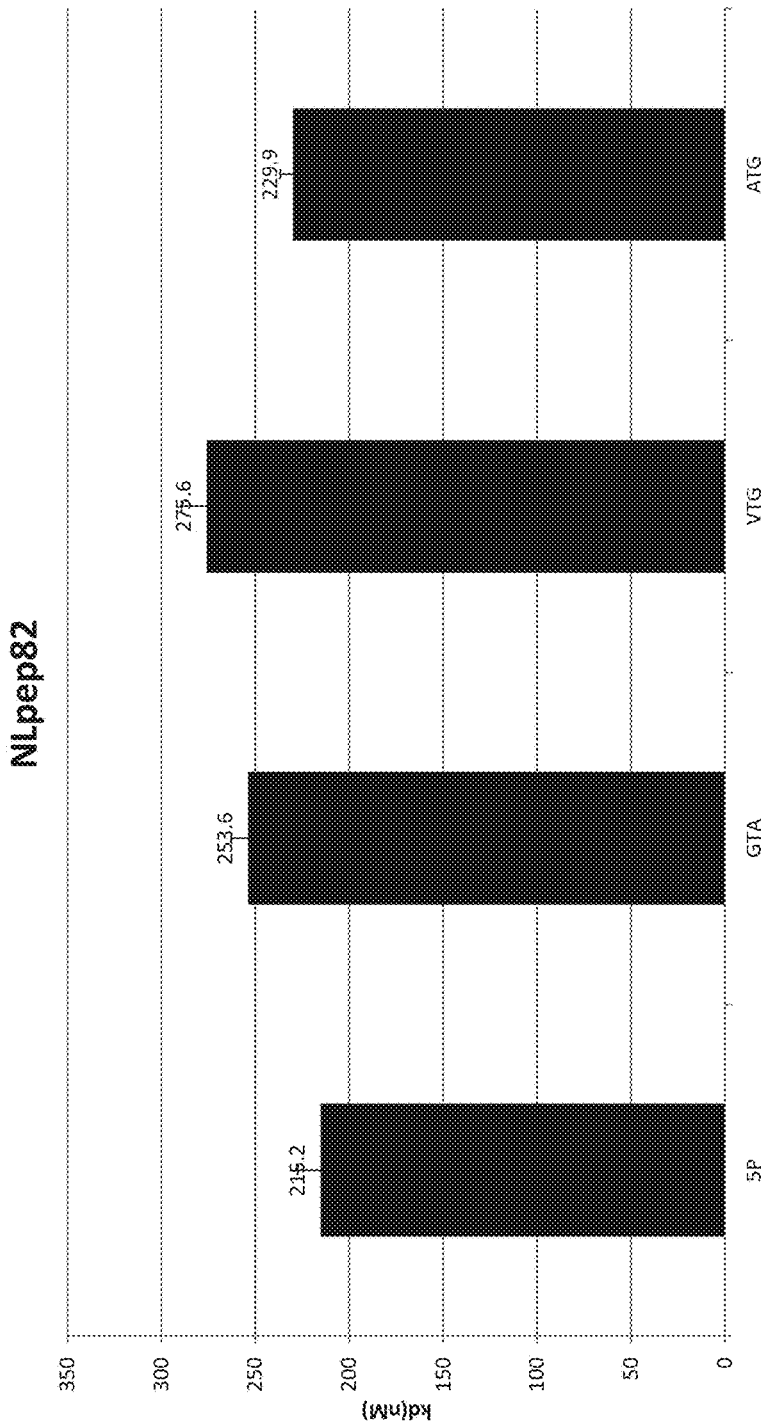
FIG. 70 shows a graph of binding affinities for several NLpoly variants with NLpep82.

Non-luminescent polypeptide lysate was prepared and diluted prepared 1:100 in PBS+0.1% PRIONEX. 2× dilutions of NLpep82 (synthetic peptide: by Peptide 2.0 (Virginia); made at either 5, 10, or 20 mg scale; blocked at the ends by acetylation and amidation, and verified by net peptide content analysis) was prepared in PBS+0.1% PRIONEX. 25 µl non-luminescent polypeptide and 25 µl of each non-luminescent peptide dilution were mixed and shaken at room temperature for 3 minutes. 50 µl of NANOGLO Luciferase Assay reagent was added and shaken at room temperature for 5 minutes. Luminescence was measured on GLOMAX with 0.5 s integration. FIG. 70 shows the calculate Kd values derived using one-site specific binding.

Example 44

Binding Affinity Between Non-Luminescent Polypeptide Clones Expressed in *E. coli* and Synthetic NLpep78

Figure 71:
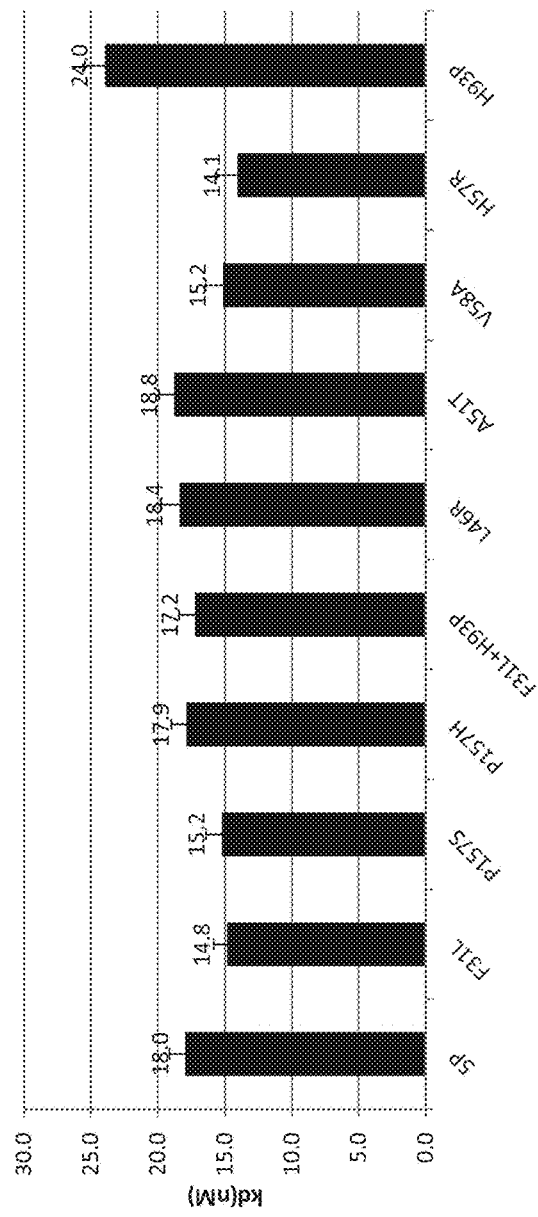
FIG. 71 shows a graph of binding affinities for several NLpoly mutants with NLpep78.

Non-luminescent polypeptide variants were grown in M9 minimal media. Individual colonies were inoculated and grown overnight at 37° C. Samples were diluted 1:20 in M9 minimal media and grown overnight at 37° C. Samples were again diluted 1:20 in M9 induction media and grown overnight at 25° C. Samples were pooled, and 100 µl of the pooled cells were lysed with 400 µl of PLB lysis buffer and incubate at room temperature for 10 minutes. The lysates were diluted 1:100 in PBS+0.1% PRIONEX. 2× dilutions of synthetic NLpep78 were made in PBS+0.1% PRIONEX. 25 µl of non-luminescent polypeptide dilution was mixed with 25 µl of each non-luminescent peptide dilution and incubated for 3 minutes at room temperature. 50 µl of NANOGLO Luciferase Assay Reagent was added, incubated at room temperature for 5 minutes, and luminescence read on GLOMAX Multi+. FIG. 71 shows the calculate Kd values derived using one-site specific binding.

Example 45

Determination of the Effect of Mutations on Km

Using diluted pooled lysates from Example 11, 25 µl of non-luminescent polypeptide diluted lysate (1:100 in PBS+0.1% PRIONEX) was mixed with 25 µl of 500 nM NLpep78 for each sample and incubated at room temperature for 5 minutes. 2× dilutions of Furimazine in NANOGLO Luciferase Assay Buffer were prepared, and 50 µl of non-luminescent peptide and non-luminescent polypeptide sample mixed with 50 µl of NANOGLO/Furimazine dilutions. Luminescence was measured after 5 minute incubation at room temperature.

Figure 72:
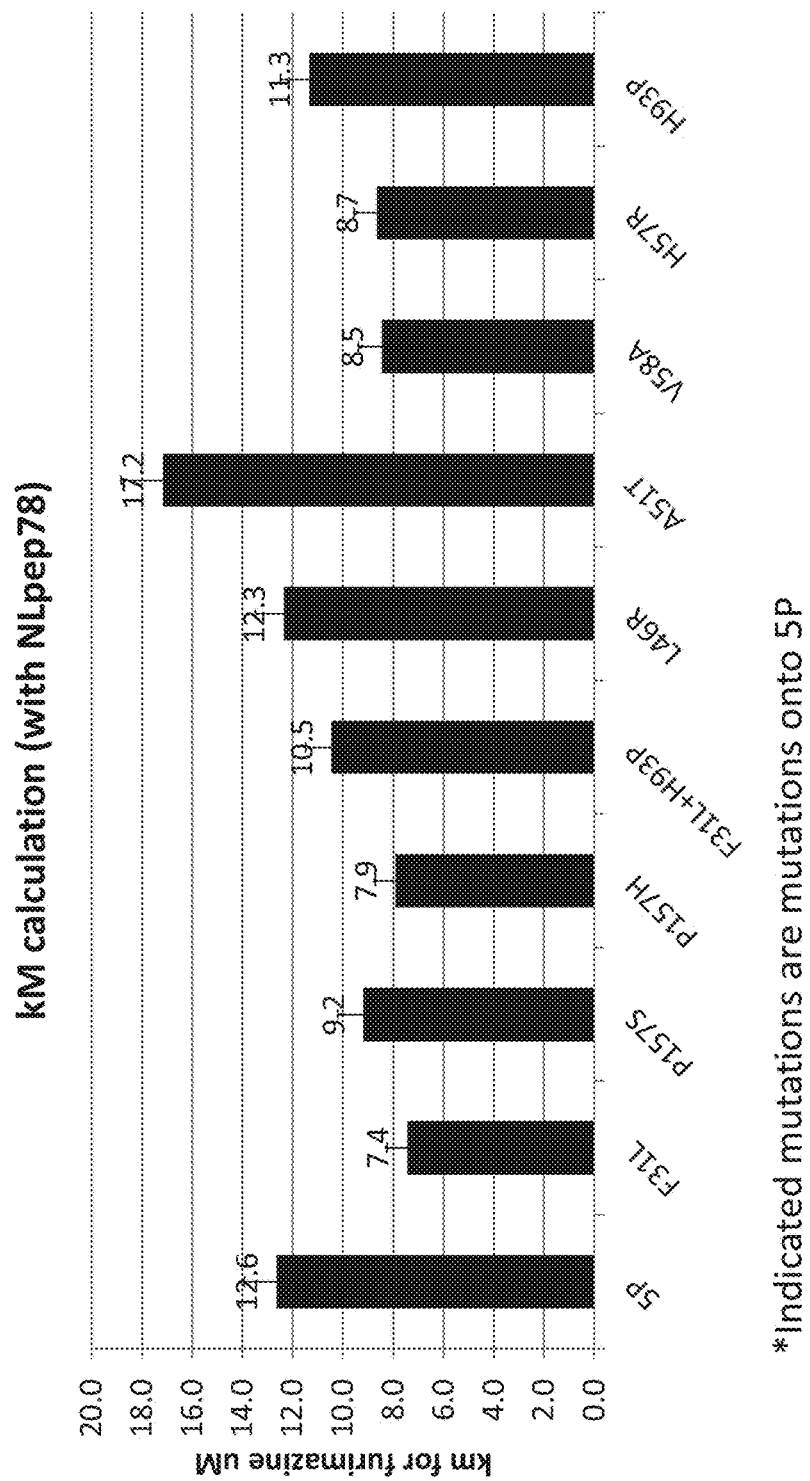
FIG. 72 shows a graph of Michaelis constants for several NLpoly mutants with NLpep78.

FIG. 72 show the calculated Km derived using Michaelis-Menten.

Example 46

Demonstration of a Three-Component Complementation

A tertiary complementation using 2 NLpeps and NLpoly 5P non-luminescent polypeptide is demonstrated. NLpoly 5P-B9 (5P with residues 147-157 deleted) and NLpep B9-HT (Met+residues 147-157 fused to N-terminus of HT7) lysates were prepared.

A) NLpoly 5P-B9+NLpoly B9 titration with NLpep78

NLpoly 5P-B9+NLpoly B9 was titrated with NLpep78, 20 μl 5P-B9 (undiluted) was mixed with 20 μl peptideB9-HT (undiluted). Dilutions of NLpep78 (synthetic peptide, highest concentration=100 uM) were made in PBS+0.1% PRIONEX. 20 μl NLpep78 was added to 40 μl of the 5P-B9+peptideB9-HT mixture and shaken at room temperature for 10 minutes. 60 μl NANOGLO Luciferase Assay Reagent was added and shaken at room temperature for 10 minutes. Luminescence was measured on GLOMAX with 0.5 s integration.

B) NLpoly 5P-B9+NLpep78 titration with NLpepB9-HT

20 μl NLpoly 5P-B9 (undiluted) was mixed with 20 μl NLpep78 (100 uM). Dilutions of peptideB9-HT (highest concentration=undiluted) were made in PBS+0.1% PRIONEX. 20 μl of peptideB9-HT was added to 40 μl of the 5P-B9+NLpep78 mixture and shaken at room temperature for 10 minutes. 60 μl NANOGLO Luciferase Assay Reagent was added and shaken at room temperature for 10 minutes. Luminescence was measured on GLOMAX with 0.5 s integration.

Figure 73:
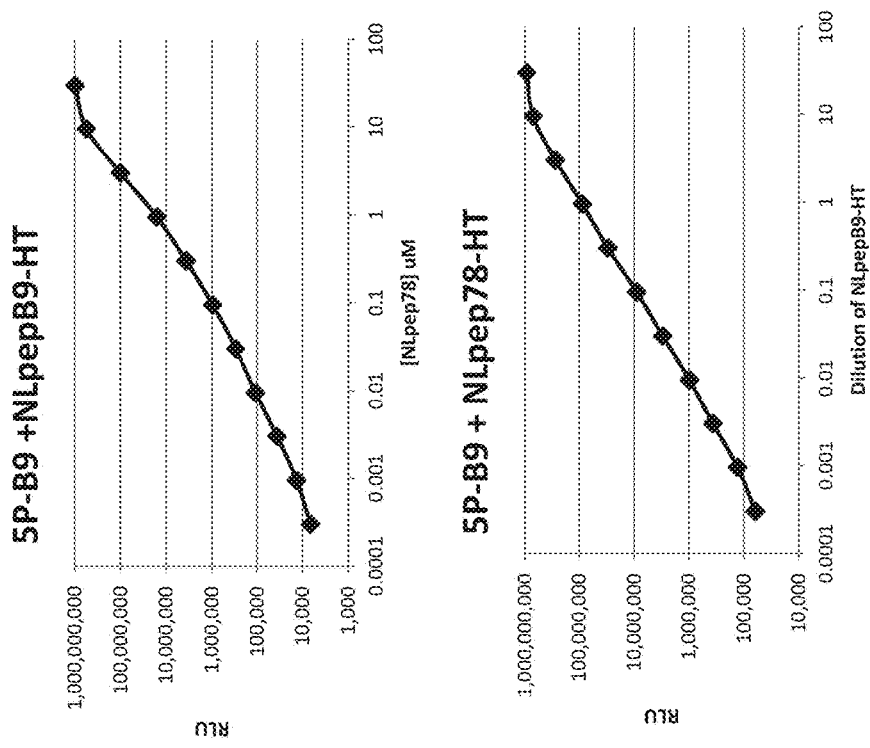
FIG. 73 shows graphs of luminescence from a tertiary complementation of two NLpeps and NLpoly 5P-B9.

FIG. 73 demonstrates the feasibility of a ternary system consisting of 2 different NLpeps and a truncated NLpoly. Since all 3 components are non-luminescent without the other 2, this system could be configured such that each NLpep is fused (synthetically or genetic engineering) to a binding moiety and the truncated NLpoly used at high concentrations to produce light only in the presence of an interaction between the binding moieties, or such that each of the 3 components are fused to binding moieties to produce light only in the event of ternary complex formation.

Example 47

Complementation with NLpep88 (NLpep78 with Gly as 6th Residue Instead of Arg)

Figure 74:
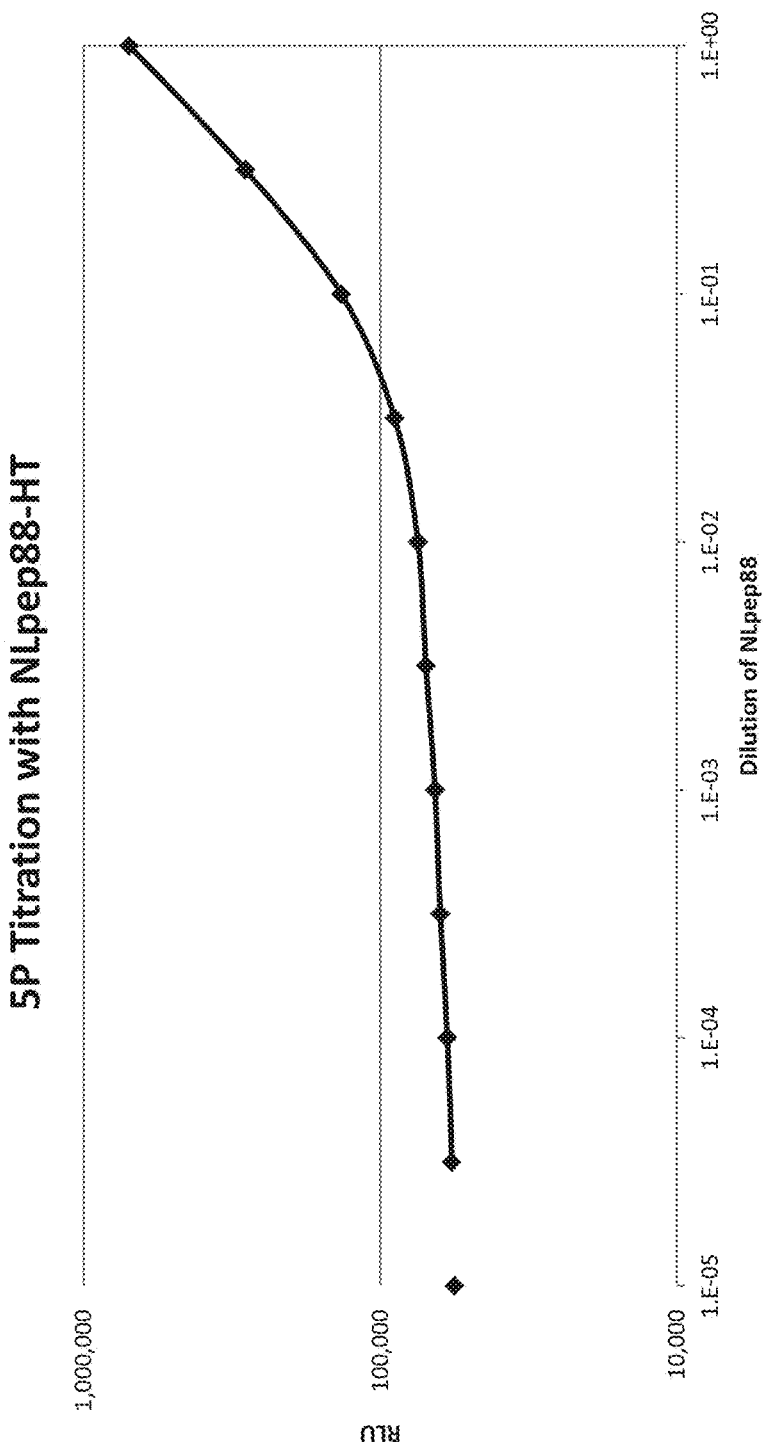
FIG. 74 shows a graph of luminescence of titration of NLpoly 5P with NLpep88-HT.

NLpep88-HT and 5P *E. coli* clarified lysates were prepared as previously described. Serial dilutions of NLpep88-HT lysate were made in PBS+0.1% PRIONEX. 20 μl of 5P lysate and 20 μl NLpep88-HT lysate were mixed and shaken at room temperature for 10 minutes. 40 μl of NANOGLO Luciferase Assay Reagent was added and shaken at room temperature for 10 minutes. Luminescence was measured on GLOMAX with 0.5 s integration. FIG. 74 demonstrates the importance of the arginine residue at the 6th position of the NLpep. While there is no increase in luminescence above 5P alone at lower concentrations of NLpep88, high concentrations of NLpep increased the luminescence suggesting a catalytically compromised complex and not a lack of interaction between 5P and NLpep88.

Example 48

Subcellular Localization of NLpep78 and 79 as N-Terminal Fusions to HALOTAG

Figure 75:
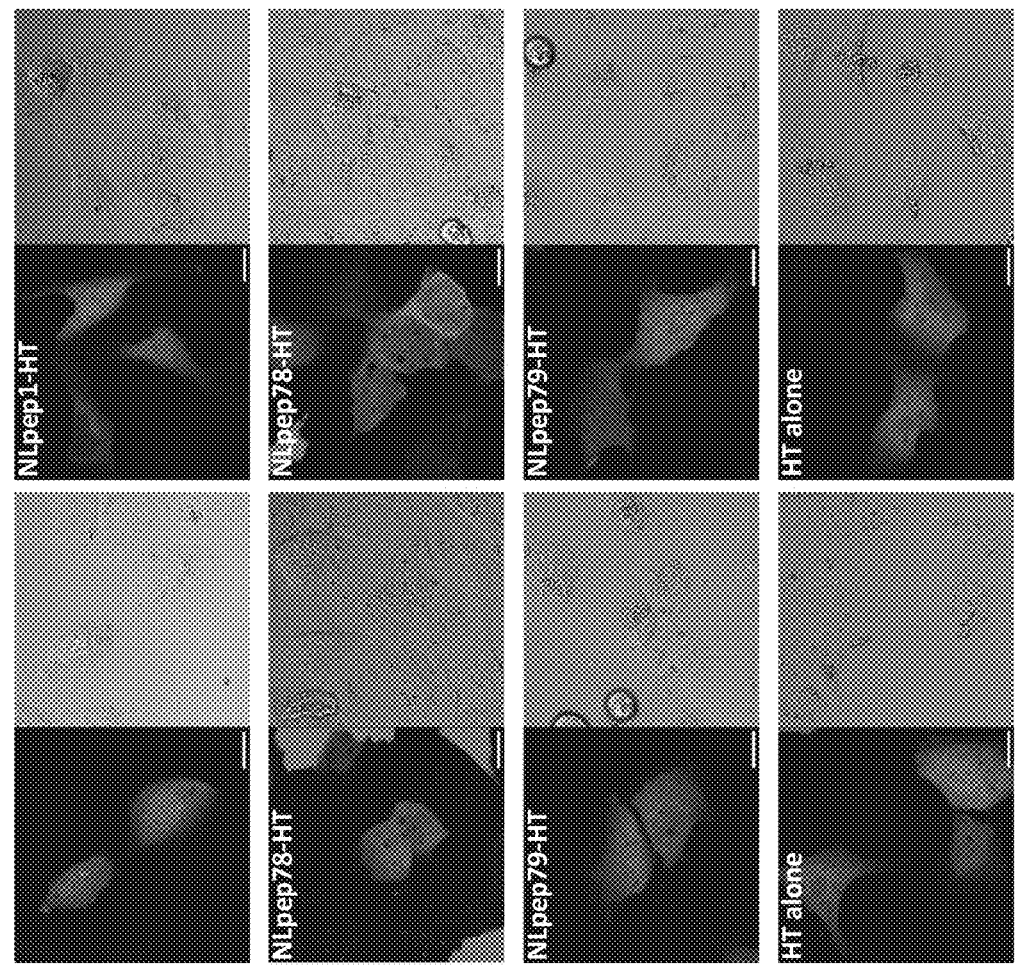
FIG. 75 shows images of intracellular localization of various NLpep fusions with HALOTAG(HT).

U2OS cells were plated and left to recover overnight at 37° C. Cells were then transfected with HALOTAG alone DNA construct or the HALOTAG-NANOLUC peptide DNA constructs (all under the control of CMV promoter): P1-HT, P78-HT or P79-HT diluted 1:10 with carrier DNA (pSI) using FuGENE HD and incubated for 24 hours at 37° C. Cells were then labeled with HALOTAG-TMR ligand by the manufacturer's standard rapid labeling protocol and imaged. FIG. 75 demonstrates that NLpep78 and 79 do not alter the intracellular localization of the HALOTAG protein.

Example 49

Subcellular Localization of Non-Luminescent Polypeptide (WT and 5P)

Figure 76:
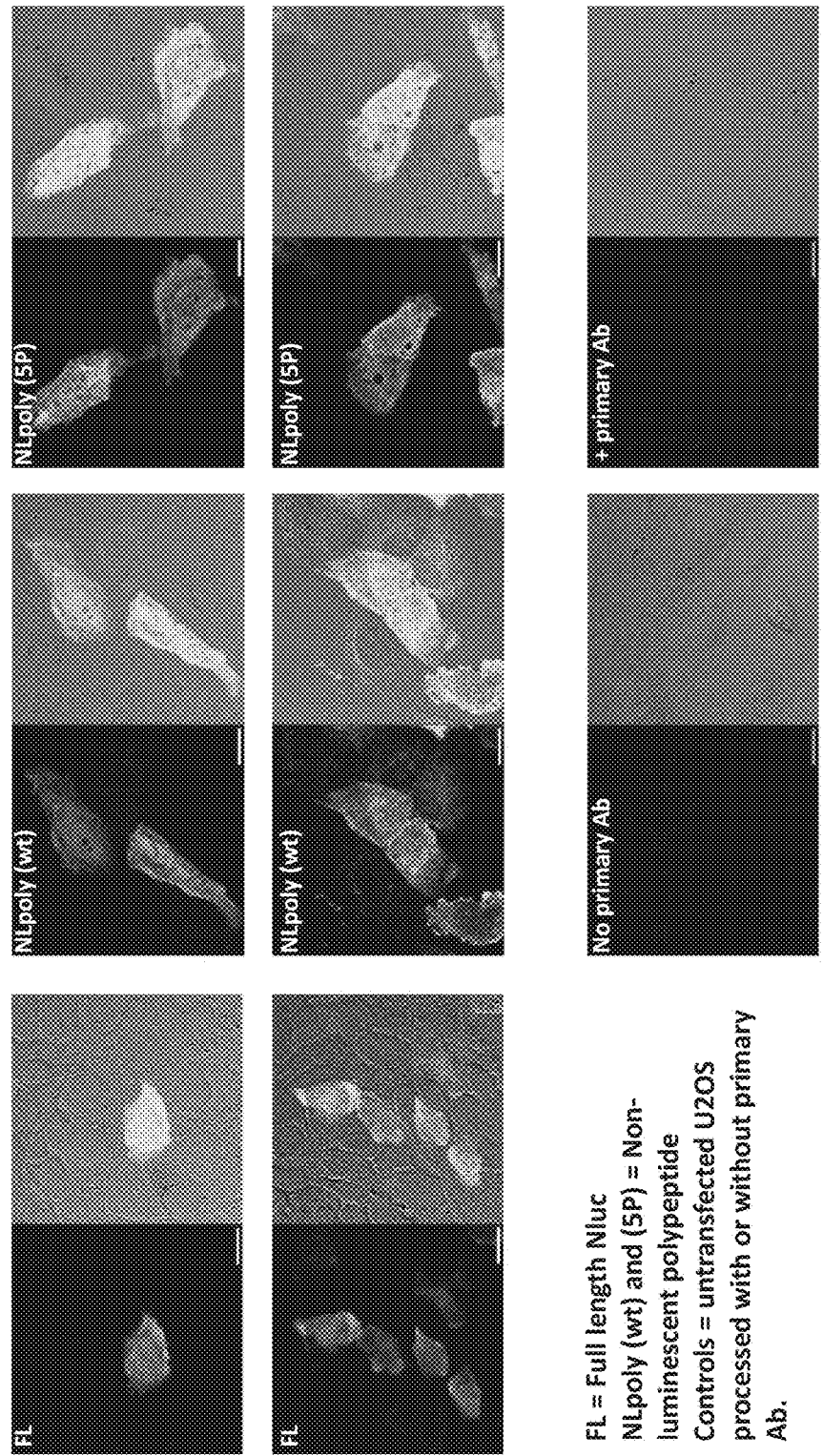
FIG. 76 shows images of intracellular localization of NLpoly(wt) and NLpoly(5P).

U2OS cells were plated and left to recover overnight at 37° C. Cells were either kept as non-transfection controls or transfected with the NANOLUC DNA constructs: FL, NLpoly (wt) or NLpoly(5P) diluted 1:10 with carrier DNA (pSI) using FuGENE HD and incubated for 24 hours at room temperature. Cells were fixed and subsequently processed for ICC. ICC was done using 1:5000 GS (PRO) primary antibody overnight at 4° C. followed by an Alexa488 goat anti-rabbit secondary antibody. FIG. 76 demonstrates that both NLpoly WT and NLpoly 5P localize uniformly in cells.

Example 50

Figure 77:
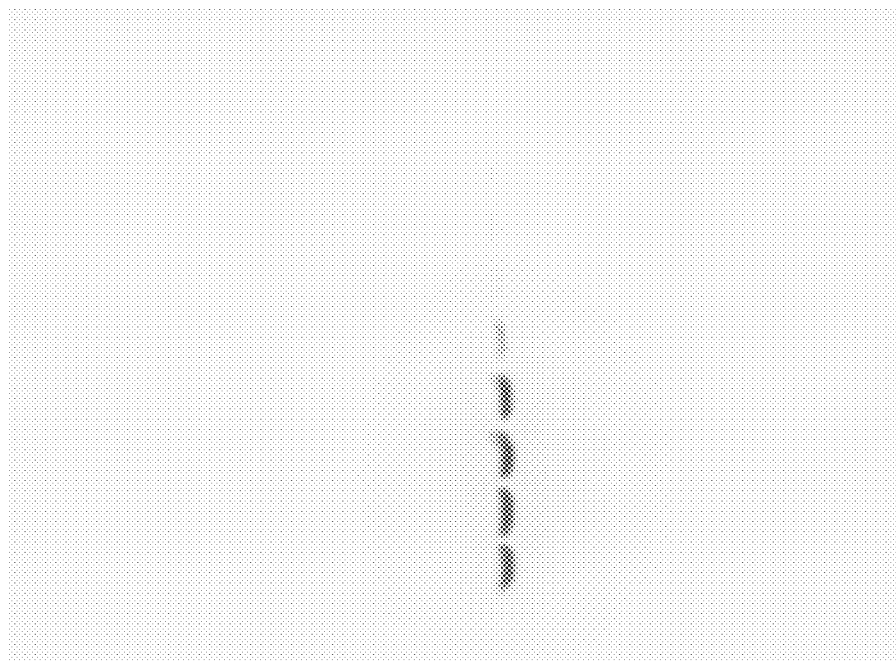
FIG. 77 demonstrates the ability to detect via complementation an NLPep-conjugated protein of interest following separation by SDS-PAGE and transfer to a PVDF membrane.

Demonstration that Non-Luminescent Polypeptide can Easily and Quickly Detect Non-Luminescent Peptide Conjugated to a Protein of Interest 99 μl of NLpep53-HT *E. coli* clarified lysate was mixed with 24.75 μl 4×SDS loading buffer. 1:10 serial dilutions of the lysate-loading buffer mixture were made and incubated at 95° C. for 5 minutes. 15 μl was loaded onto a SDS-PAGE gel. After gel completions, it was transferred to PVDF using iBlot and washed with 10 mL NLpoly L149M *E. coli* clarified lysate at room temperature for 30 minutes. The membrane was then placed on a LAS4000 imager and 2 mL NANOGLO Luciferase Assay Reagent added. A 60 second exposure was taken (FIG. 77).

Example 51

Site Saturation at Non-Luminescent Polypeptide Positions 31, 46, 108, 144, and 157 in the Context of 5P Single amino acid change variants were constructed onto NLpoly 5P (pF4Ag vector background) at the sites according to table 5 below. In effect, the native residue was varied to each of the 19 alternative amino acids for a total of 95 variants.

TABLE 5

| Position 31 | | Position 46 | | Position 108 | | Position 144 | | Position 157 | |
|---|---|---|---|---|---|---|---|---|---|
| B1 | Ala | E3 | Ala | H5 | Ala | C8 | Ala | F10 | Ala |
| C1 | Cys | F3 | Cys | A6 | Cys | D8 | Cys | G10 | Cys |

TABLE 5-continued

| Position 31 | | Position 46 | | Position 108 | | Position 144 | | Position 157 | |
|---|---|---|---|---|---|---|---|---|---|
| D1 | Asp | G3 | Asp | B6 | Asp | E8 | Asp | H10 | Asp |
| E1 | Glu | H3 | Glu | C6 | Glu | F8 | Glu | A11 | Glu |
| F1 | Gly | A4 | Phe | D6 | Phe | G8 | Phe | B11 | Phe |
| G1 | His | B4 | Gly | E6 | Gly | H8 | Gly | C11 | Gly |
| H1 | Ile | C4 | His | F6 | His | A9 | His | D11 | His |
| A2 | Lys | D4 | Ile | G6 | Ile | B9 | Ile | E11 | Ile |
| B2 | Leu | E4 | Lys | H6 | Lys | C9 | Lys | F11 | Lys |
| C2 | Met | F4 | Met | A7 | Leu | D9 | Leu | G11 | Leu |
| D2 | Asn | G4 | Asn | B7 | Met | E9 | Met | H11 | Met |
| E2 | Pro | H4 | Pro | C7 | Pro | F9 | Asn | A12 | Asn |
| F2 | Gln | A5 | Gln | D7 | Gln | G9 | Pro | B12 | Gln |
| G2 | Arg | B5 | Arg | E7 | Arg | H9 | Gln | C12 | Arg |
| H2 | Ser | C5 | Ser | F7 | Ser | A10 | Arg | D12 | Ser |
| A3 | Thr | D5 | Thr | G7 | Thr | B10 | Ser | E12 | Thr |
| B3 | Val | E5 | Val | H7 | Val | C10 | Val | F12 | Val |
| C3 | Trp | F5 | Trp | A8 | Trp | D10 | Trp | G12 | Trp |
| D3 | Tyr | G5 | Tyr | B8 | Tyr | E10 | Tyr | H12 | Tyr |

Individual colonies were grown in LB+amp and incubated overnight at 30° C. A 5P control was also included. The overnight cultures were used to inoculate fresh LB+amp (1:100), and these cultures grew for 2 hours 45 minutes at 37° C. Rhamnose was added to 0.2%, and the cultures left to grow/induce overnight at 25° C. After 18 hours of induction, cells were lysed using 0.5× FastBreak (30 min ambient temperature), snap frozen on dry ice, and stored at −20° C. Following a fast thaw, samples were assayed in the absence and presence of Pep87 (aka NLpep 87).

For the (−) peptide reactions, 30 uL lysate was incubated with 30 uL PBS pH 7.5 for 10 min and then 60 uL NANOGLO Luciferase Assay reagent (Promega Corporation) added. After 5 minutes, luminescence was measured. For the (+) peptide reactions, 30 uL lysate was incubated with 30 uL of 8 nM Pep87. After 10 min, 60 uL NANOGLO Luciferase Assay reagent was added, and luminescence measured at 5 minutes.

Figure 78:
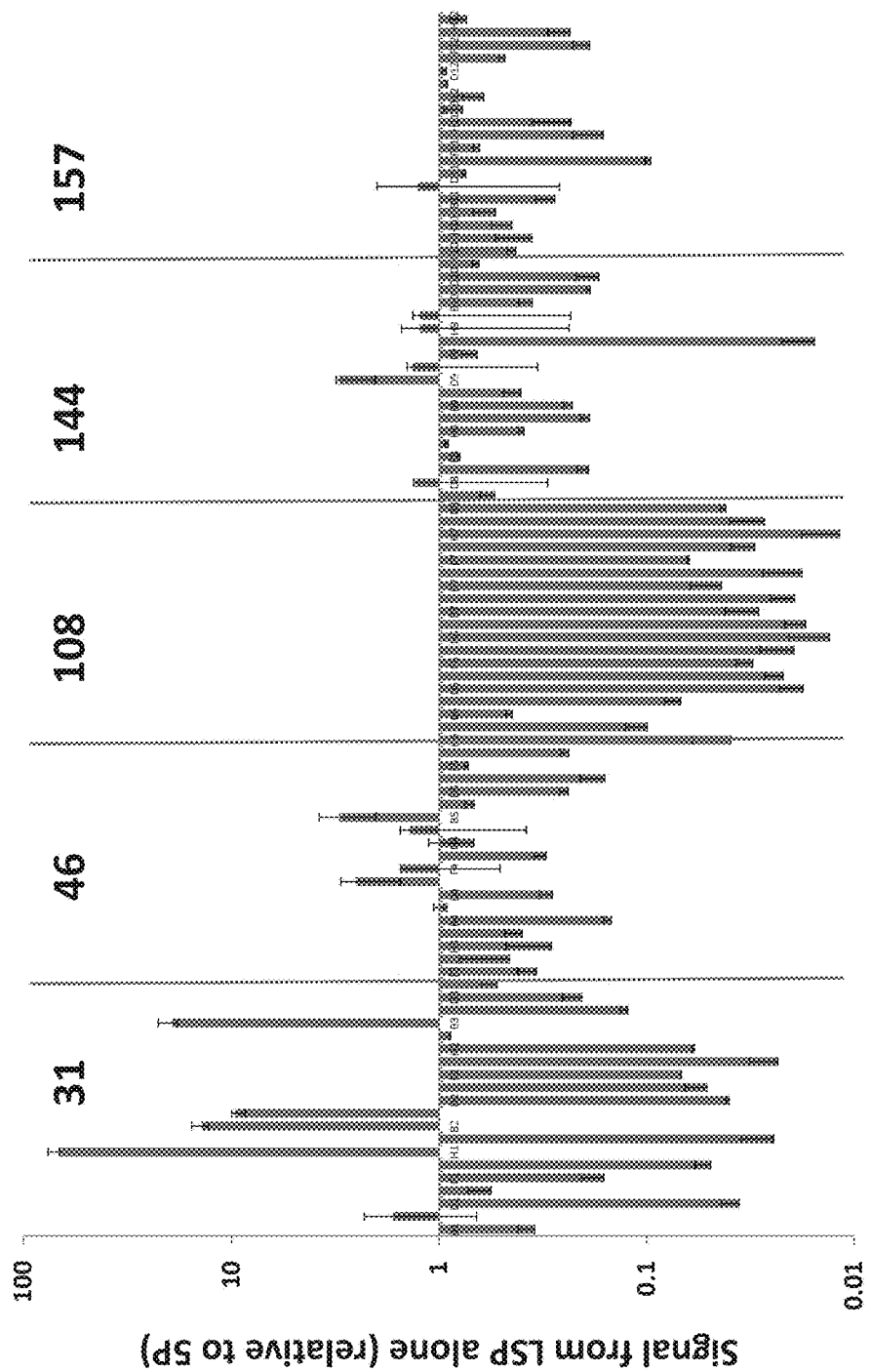
FIG. 78 shows a graph of relative luminescent signal from various NLpoly variants compared to NLpoly 5P (in the absence of NLpep).
Figure 79:
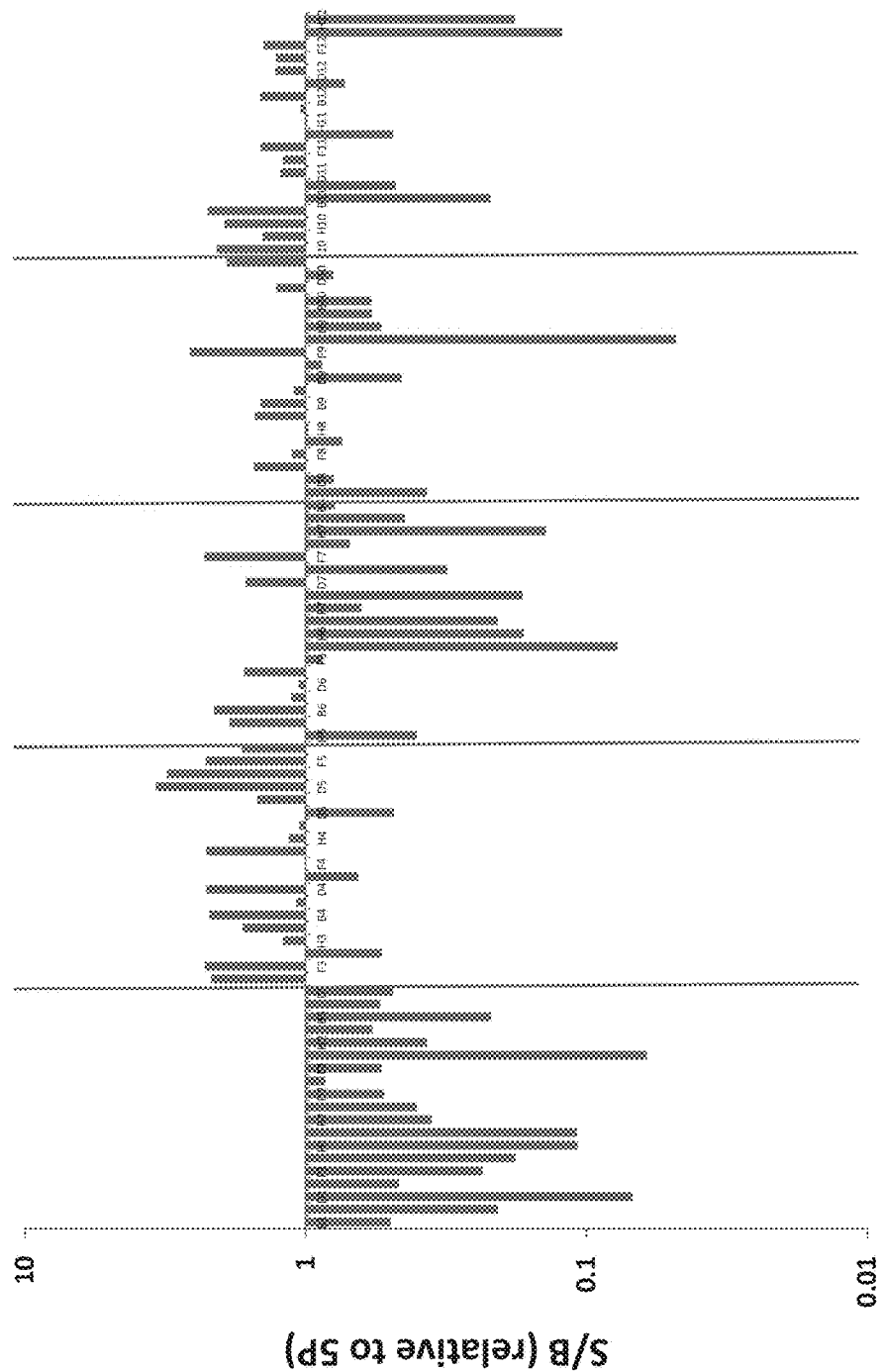
FIG. 79 shows a graph of relative luminescent signal over background from various NLpolys compared to NLpoly 5P (in the absence of NLpep).

Luminescence (RLU) data for the (−) peptide samples were normalized to the readings for the 5P control, and these results are presented in FIG. 78. Luminescence (RLU) data for the (+) peptide samples were also normalized to 5P, but then also normalized to the values in FIG. 76 in order to represent signal to background (S/B; FIG. 79).

Example 52

Use of the High Affinity Between NLpoly and NLpep for Protein Purification/Pull Downs MAGNEHALOTAG beads (Promega Corporation; G728A) were equilibrated as follows: a) 1 mL of beads were placed on magnet for ~30 sec, and the buffer removed; b) the beads were removed from magnet, resuspended in 1 mL PBS+0.1% PRIONEX, and shaken for 5 min at RT; and c) steps a) and b) were repeated two more times NLpep78-HALOTAG (E. coli clarified lysate) was bound to MAGNEHALOTAG beads by resuspending the beads in 1 mL NLpep78-HT clarified lysate, shaking for 1 hr at RT and placing on magnet for ~30 sec. The lysate (flow through) was removed and saved for analysis. NLpoly 8S (E. coli clarified lysate) was bound to the NLpep78 bound-Magne HALOTAG beads from the step above by resuspending the beads in 1.5 mL 8S lysate, shaking for 1 hr at RT and placing on a magnet for ~30 sec. The lysate (flow through) was removed and saved for analysis. The beads were resuspended in 1 mL PBS+0.1% PRIONEX, shaken for 5 min at RT, placed on magnet for ~30 sec, and PBS (wash) removed. The beads were washed three more times.

To elute the bound peptide/polypeptide, the beads were resuspended in 500 uL 1×SDS buffer and shaken for 5 min at RT The beads were then placed on a magnet for ~30 sec; the SDS buffer (elution) removed and saved for analysis. The elution was repeated one more time.

The samples were then analyzed by gel. 37.5 uL of sample (except elutions) was mixed with 12.5 uL 4×SDS buffer and incubated at 95° C. for 5 min. 5 uL was loaded onto a Novex 4-20% Tris-Glycine gel and run at ~180V for ~50 min. The gel was stained with SimplyBlue Safe Stain and imaged on a LAS4000 imager.

Figure 94:
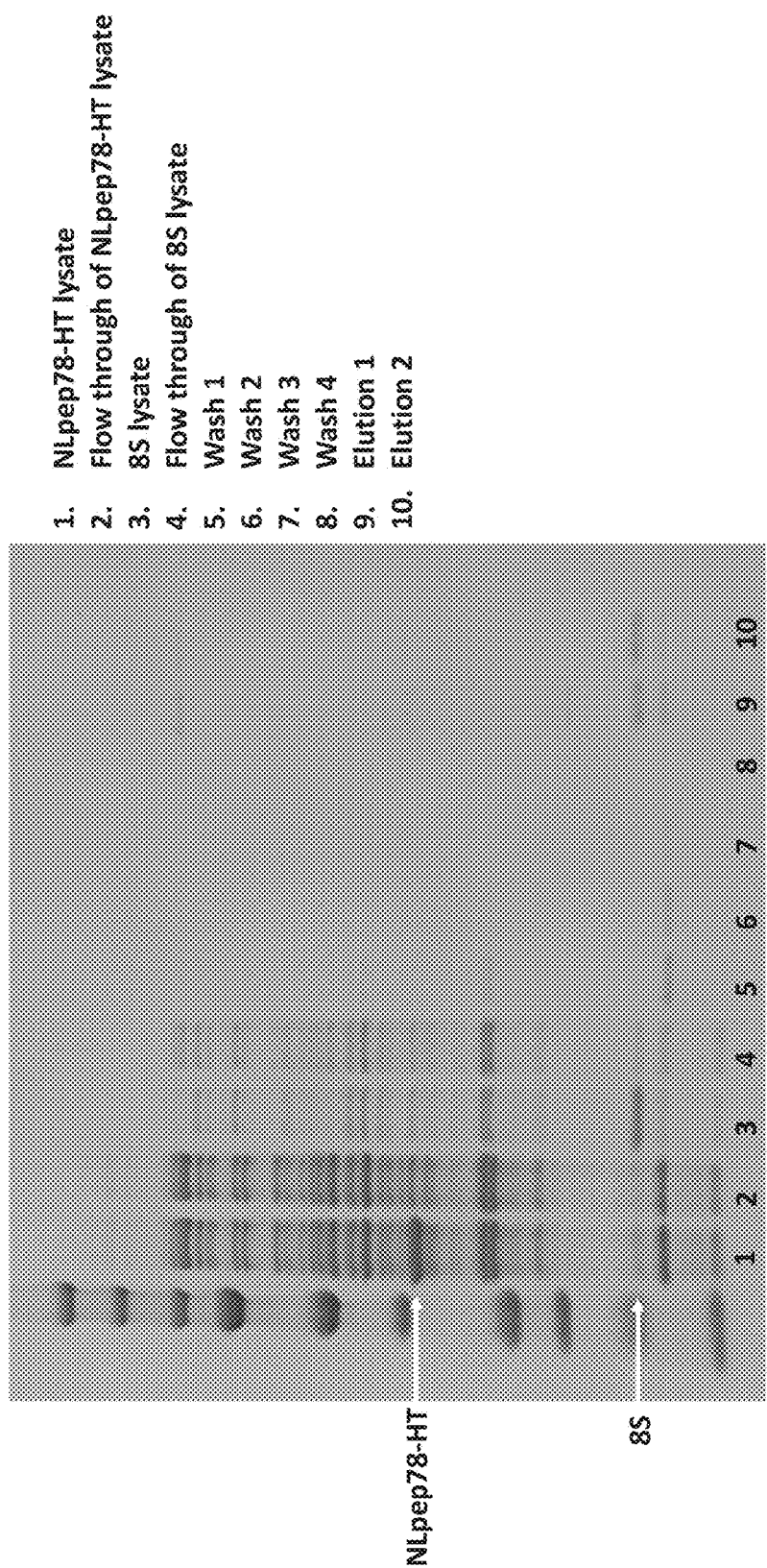
FIG. 94 shows an image of a protein gel that follows the affinity purification of NLpoly 8S through binding NLpep78.

FIG. 94 illustrates that the affinity of NLpoly and NLpep is sufficient to allow for purification from an E. coli lysate. As NLpoly 8S was purified from an E. coli lysate, it is reasonable to expect a protein fused to NLpoly 8S (or other variant described herein) could also be purified in a similar fashion. While in this example the NLpep was immobilized and used to purify NLpoly, it is also reasonable to expect a similar result if NLpoly were immobilized.

Example 53

Kinetics of NLpoly/NLpep Binding

2× concentrations of synthetic NLpep were made and diluted 2.7-fold nine times (10 concentrations) in PBS+ 0.1%. Final concentrations used in the assay were 30 uM-3.9 nM. WT NLpoly (E. coli clarified lysate; 1:10,000) or 11S (1:10,000.000) was diluted in NANOGLO+100 uM Furmazine (Fz). 50 uL of NLpep was placed into wells of white 96-well assay plate. 50 uL NLpoly/NANOGLO/Fz was injected into the wells using the injector on GLOMAX Multi+instrument, and luminescence measured every 3 sec over 5 min. $k_{obs}$ was found by fitting data to: $Y=Y_{max}(1-e^{-k_{obs}t})$ using Graphpad Prism, $k_{on}$ and $k_{off}$ were then fitted to: $k_{obs}=[NLpep]k_{on}+k_{off}$. FIG. 95 illustrates the association and dissociation rate constants for the binding between NLpolys and NLpeps.

Example 54

NLpoly/NLpep Substrate Affinity

Figure 96:
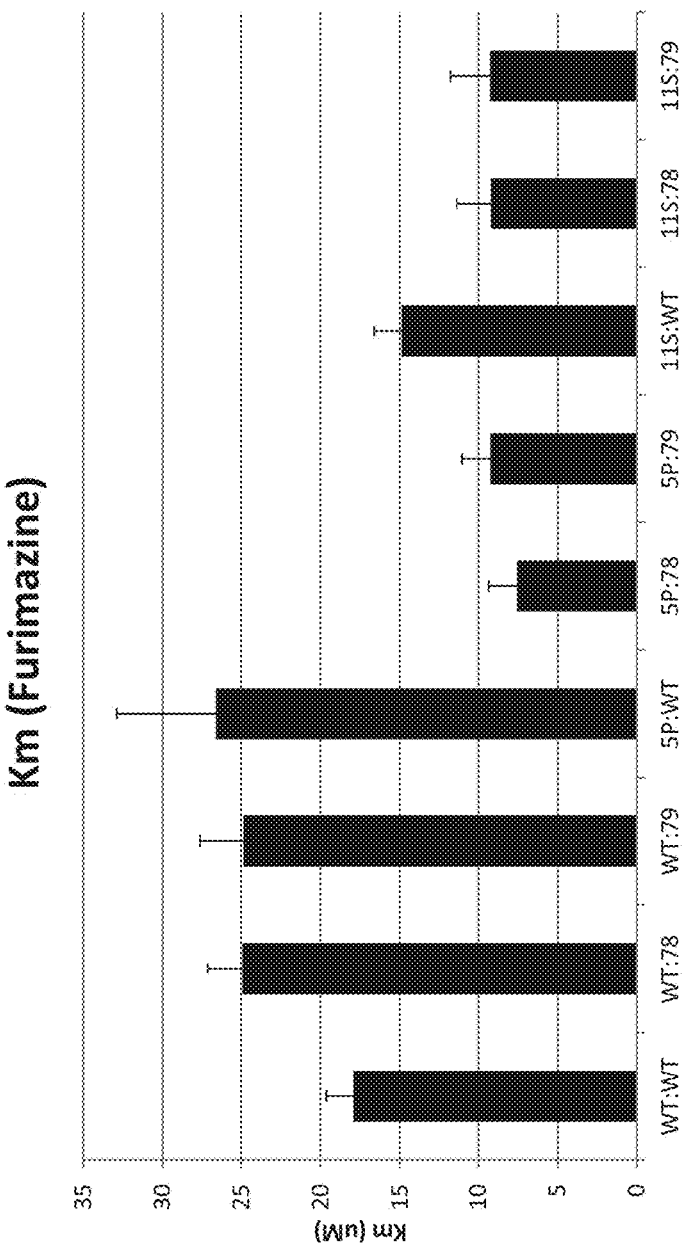
FIG. 96 shows the Km values for various pairs of NLpoly/NLpep.

NLpoly was diluted into PBS+0.1% PRIONEX as follows: WT at 1:10$^5$, 5P at 1:10$^7$, and 11S at 1:10$^8$. NLpep was diluted into PBS+0.1% PRIONEX as follows: 30 uM for WT NLpoly studies or 3 uM for NLpoly 5P and 11S studies. 50 uL NLpoly/NLpep was incubated at RT for 5 min, 50 uL NANOGLO+Fz (ranging from 100 uM to 1.2 uM, 2×) added, and incubated for 10 min at RT. Luminescence was measured on GLOMAX Multi+ with 0.5 sec integration. Km was derived using Graphpad Prism, Michaelis-Menton best-fit values. FIG. 96 illustrates the Km values for various NLpoly/NLpep pairs.

Example 55

Figure 97:
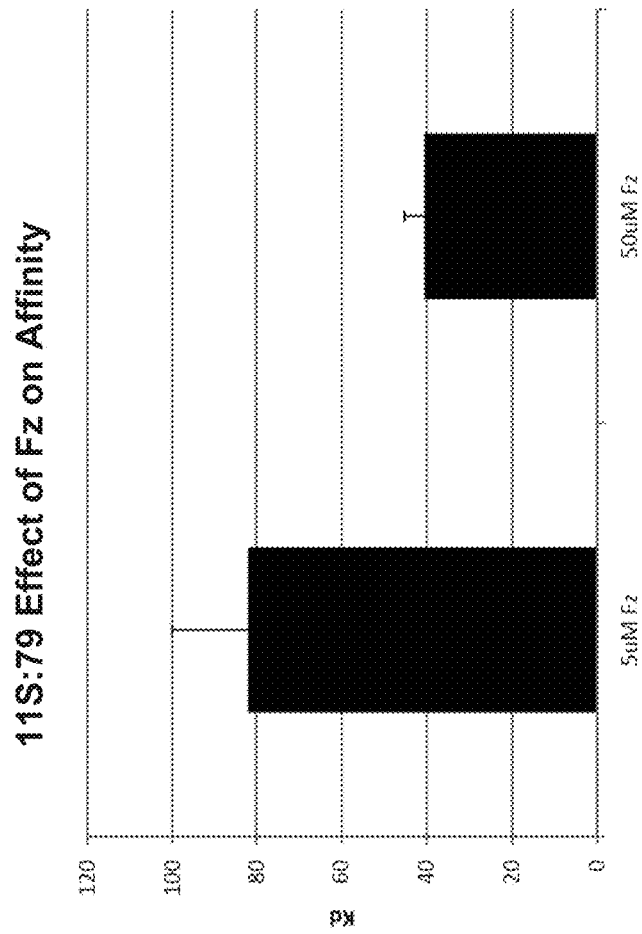
FIG. 97 compares the dissociation constant for NLpoly11S/NLpep79 at sub-saturating and saturating concentrations of furimazine.

Substrate Effect on NLpoly/NLpep Affinity 11S (E. coli clarified lysate) was diluted into PBS+0.1% PRIONEX at 1:10$^7$. Synthetic NLpep79 was diluted serially (1:2) from 800 nM to 0.39 nM (2×). 20 uL 11S+20 uL NLpep79 were then mixed and incubated for 5 min at RT. 40 uL NANOGLO+5 uM or 50 uM Fz was added and incubated another 5 min at RT. Luminescence was measured on GLOMAX Multi+ with 0.5 sec integration. Kd was derived using Graphpad prism, One site-Specific binding value. FIG. 97 illustrates that saturating concentrations of furimazine increase the affinity between 11S and NLpep79.

Example 56

Km for NLpoly 5A2:NLpep

Figure 98:
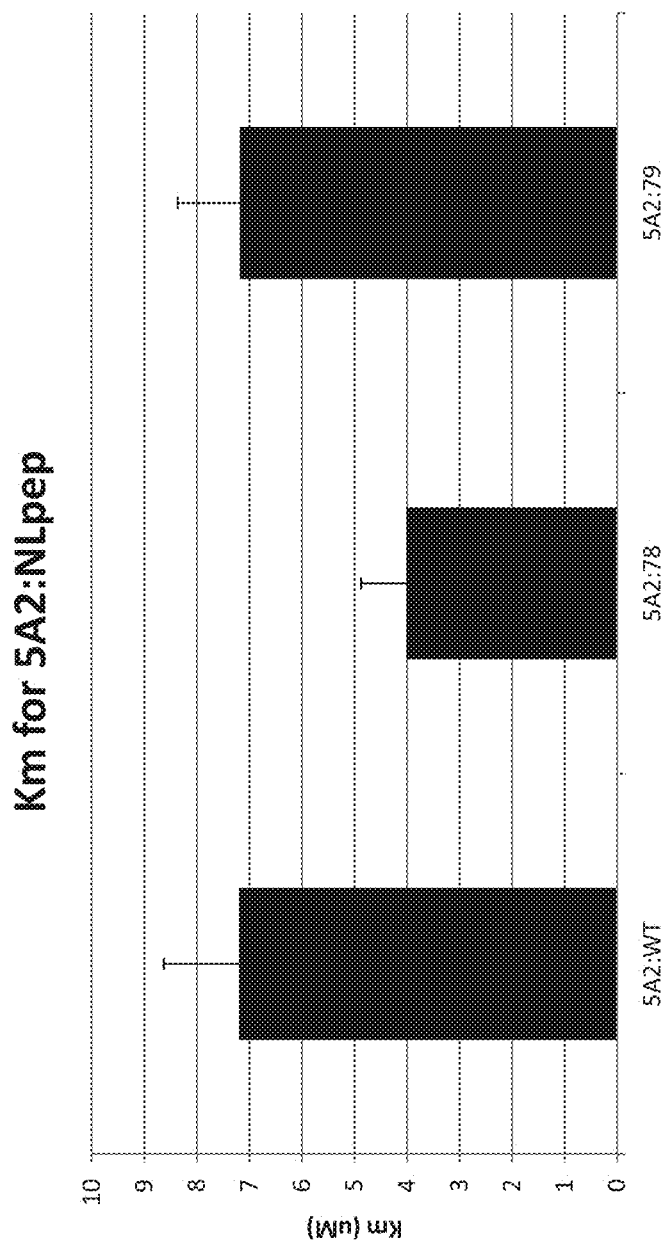
FIG. 98 compares the Km values for NLpoly 5A2 with NLpepWT, 78 and 79.

NLpoly 5A2 was diluted into PBS+0.1% PRIONEX at 1:10$^5$. NLpep (WT, NLpep 78 or NLpep79) was diluted into PBS+0.1% PRIONEX to 30 uM. 50 uL NLpolyNLpep was incubated at RT for 5 min. 50 uL NANOGLO+Fz (ranging from 100 uM to 1.2 uM, 2×) was added and incubated for 10 min at RT. Luminescence was measured on GLOMAX Multi+ with 0.5 sec integration. Km was derived using Graphpad Prism, Michaelis-Menton best-fit values. FIG. 98 illustrates the Km values for NLpoly5A2 and NLpep WT, 78, and 79.

Example 57

Luminescence of NLpoly without NLpep

Figure 99:
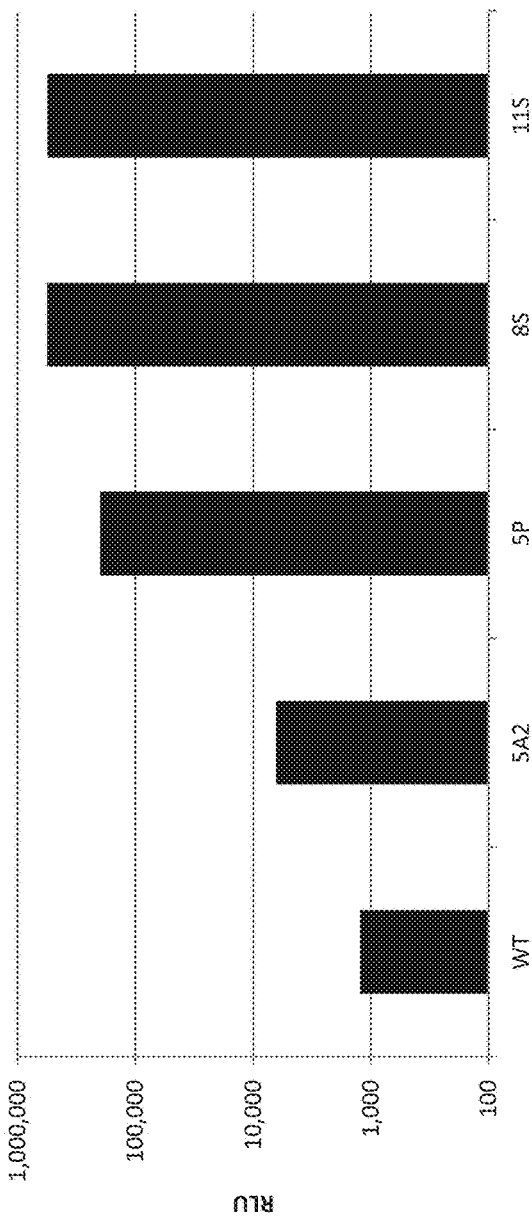
FIG. 99 shows the luminescence of NLpolys from various steps in the evolution process in the absence of NLpep.

*E. coli* clarified lysate were prepared as described previously for NLpoly WT, 5A2, 5P, 8S and 1S. 50 uL of each lysate and 50 uL NANOGLO+Fz were mixed and incubated for 5 min RT. Luminescence was measured on GLOMAX Multi+ with 0.5 sec integration. FIG. 99 illustrates that the ability of the NLpoly to produce luminescence in the absence of NLpep gradually increased throughout the evolution process resulting in ~500 fold higher luminescence for 11S than WT NLpoly.

Example 58

Improved Luminescence in *E. coli* Throughout Evolution Process

Figure 100:
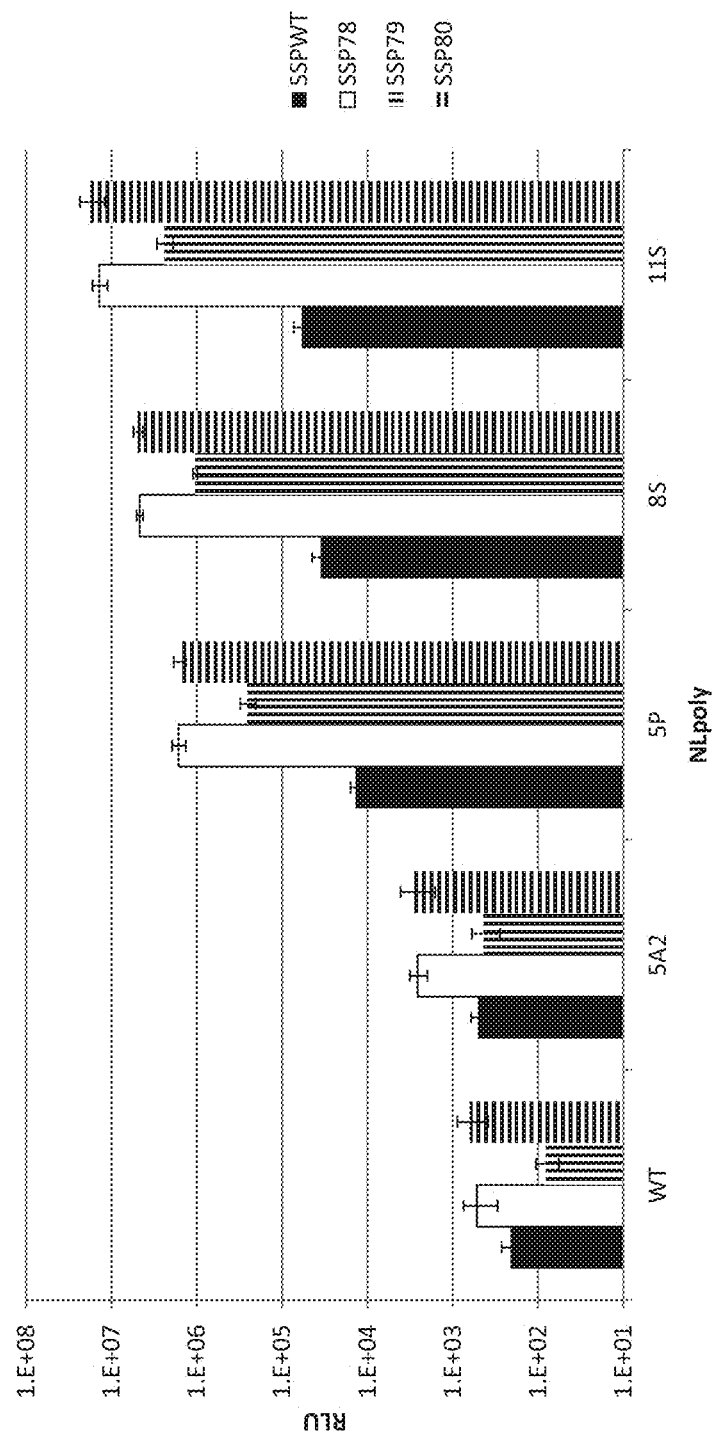
FIG. 100 shows the improvement in luminescence from *E. coli*-derived NLpoly over the course of the evolution process with an overall ~$10^5$ improvement (from NLpolyWT:NLpepWT to NLpoly11S:NLpep80).

A single NLpoly colony of WT, 5A2, 5P, 8S or 11S was inoculated in 200 uL minimal media and grown for 20 hrs at 37° C. on shaker. 10 uL of the overnight culture was diluted into 190 uL fresh minimal media and grown for 20 hrs at 37° C. on shaker. 10 uL of this overnight culture was diluted into 190 uL auto-induction media (previously described) and grown for 18 hrs at 25° C. on shaker. The auto-induced cultures were diluted 50-fold (4 uL into 196 uL assay lysis buffer), 10 uL expression culture added to 40 uL of assay lysis buffer containing NLpep (synthetic; 1 nM WT, NLpep78, NL79 or NLpep80) and shaken for 10 min at RT. 50 uL NANOGLO+Fz was added, and samples shaken for 5 min at RT. Luminescence was measured on a GLOMAX luminometer with 0.5 sec integration. FIG. 100 illustrates the improvement in luminescence from *E. coli*-derived NLpoly over the course of the evolution process, an overall ~10$^5$ improvement (from NLpolyWT:NLpepWT to NLpoly11S:NLpep80).

Example 59

Improved Luminescence in HeLa Cells Throughout Evolution Process 50 ng plasmid DNA expressing NLpoly WT, 5A2, 5P, 8S or 11 S was transfected into HeLa cells into wells of a 12-well plate using FugeneHD. The cells were then incubated overnight at 37° C./50/CO$_2$. The media was replaced with 500 uL DMEM without phenol red, and the cells frozen at −80° C. for >30 min. The cells were thawed and transferred to 1.5 mL tubes.

Figure 101:
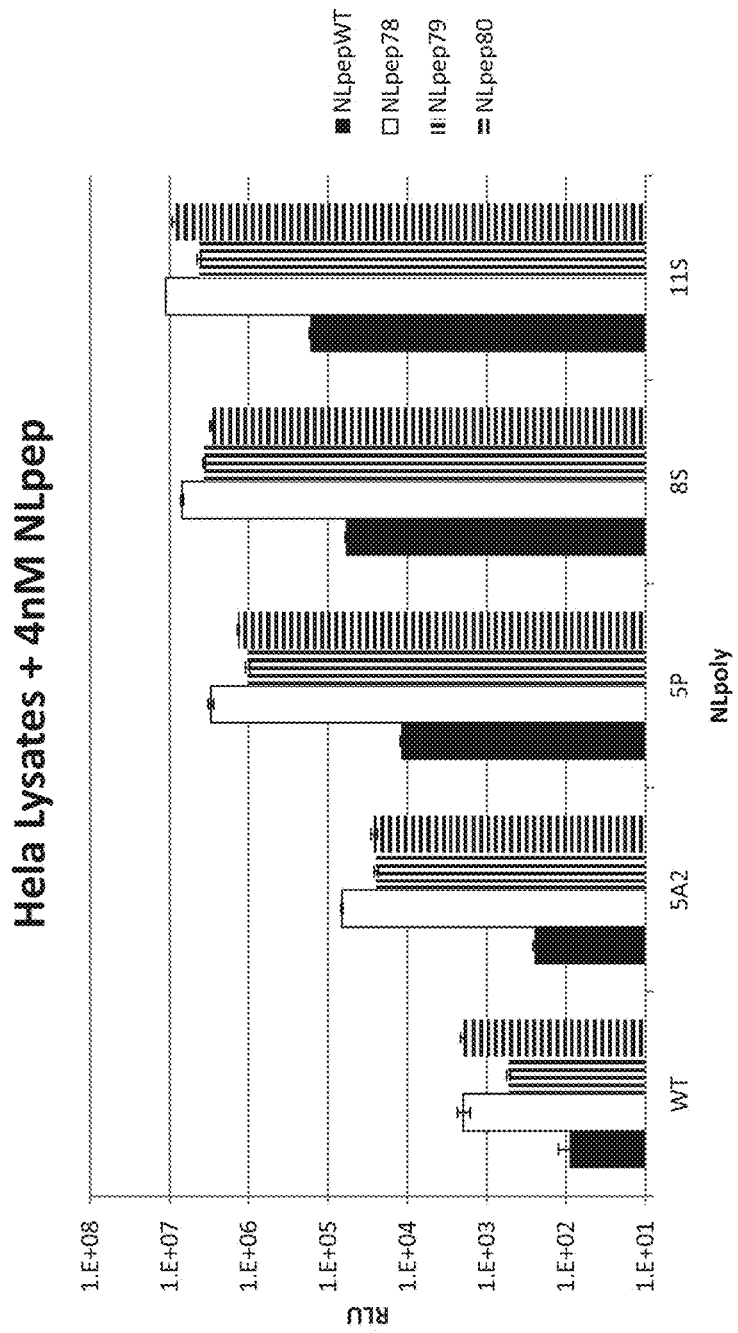
FIG. 101 shows the improvement in luminescence from HeLa-expressed NLpoly over the course of the evolution process with an overall ~$10^4$ improvement (from NLpolyWT:NLpepWT to NLpoly11S:NLpep80).

NLpep WT, NLpep78, NLpep79 or NLpep 80 (synthetic) were diluted to 10 nM in PBS+0.1% PRIONEX, and 25 μl mixed with 25 uL of each of the NLpoly cell lysate. The samples were shaken for 10 min at RT, and then 50 uL NANOGLO+100 uM Fz added and incubated for 5 min at RT. Luminescence was measured on a GLOMAX luminometer with 0.5 s integration. FIG. 101 illustrates the improvement in luminescence from HeLa-expressed NLpoly over the course of the evolution process, an overall ~10$^5$ improvement (from NLpolyWT:NLpepWT to NLpoly11S:NLpep80).

Example 60

Improved Luminescence in HEK293 Cells Throughout Evolution Process 50 ng plasmid DNA expressing NLpoly WT, 5A2, 5P, 8S or 11S was transfected into HEK293 cells into wells of a 12-well plate using FugeneHD. The cells were then incubated overnight at 37° C./5% CO$_2$. The media was replaced with 500 uL DMEM without phenol red, and the cells frozen at −80° C. for >30 min. The cells were thawed and transferred to 1.5 mL tubes.

Figure 102:
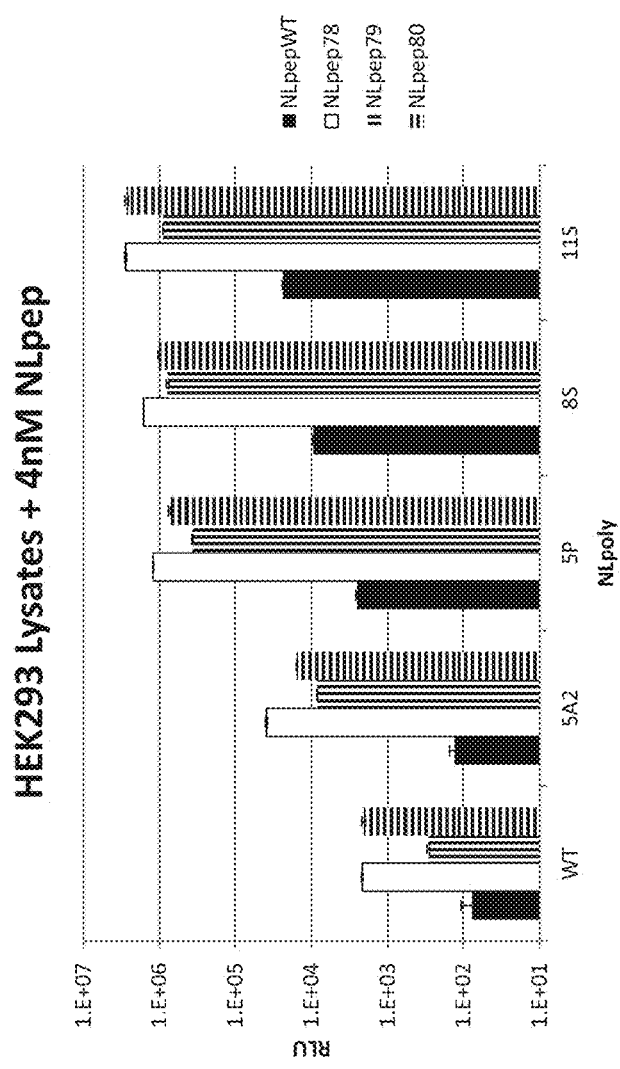
FIG. 102 shows the improvement in luminescence from HEK293 cell-expressed NLpoly over the course of the evolution process with an overall ~$10^4$ improvement (from NLpolyWT:NLpepWT to NLpoly11S:NLpep80).

NLpep WT, NLpep78, NLpep79 or NLpep 80 (synthetic) were diluted to 10 nM in PBS+0.1% PRIONEX and 25 ul mixed with 25 uL of each of the NLpoly cell lysate. The samples were shaken for 10 min at RT, and then 50 uL NANOGLO+100 uM Fz added and incubated for 5 min at RT. Luminescence was measured on a GLOMAX luminometer with 0.5 s integration. FIG. 102 illustrates the improvement in luminescence from HEK293-expressed NLpoly over the course of the evolution process, an overall ~10$^4$ improvement (from NLpolyWT:NLpepWT to NLpoly11S:NLpep80).

Example 61

Improved Binding Affinity Throughout Evolution

Figure 103:
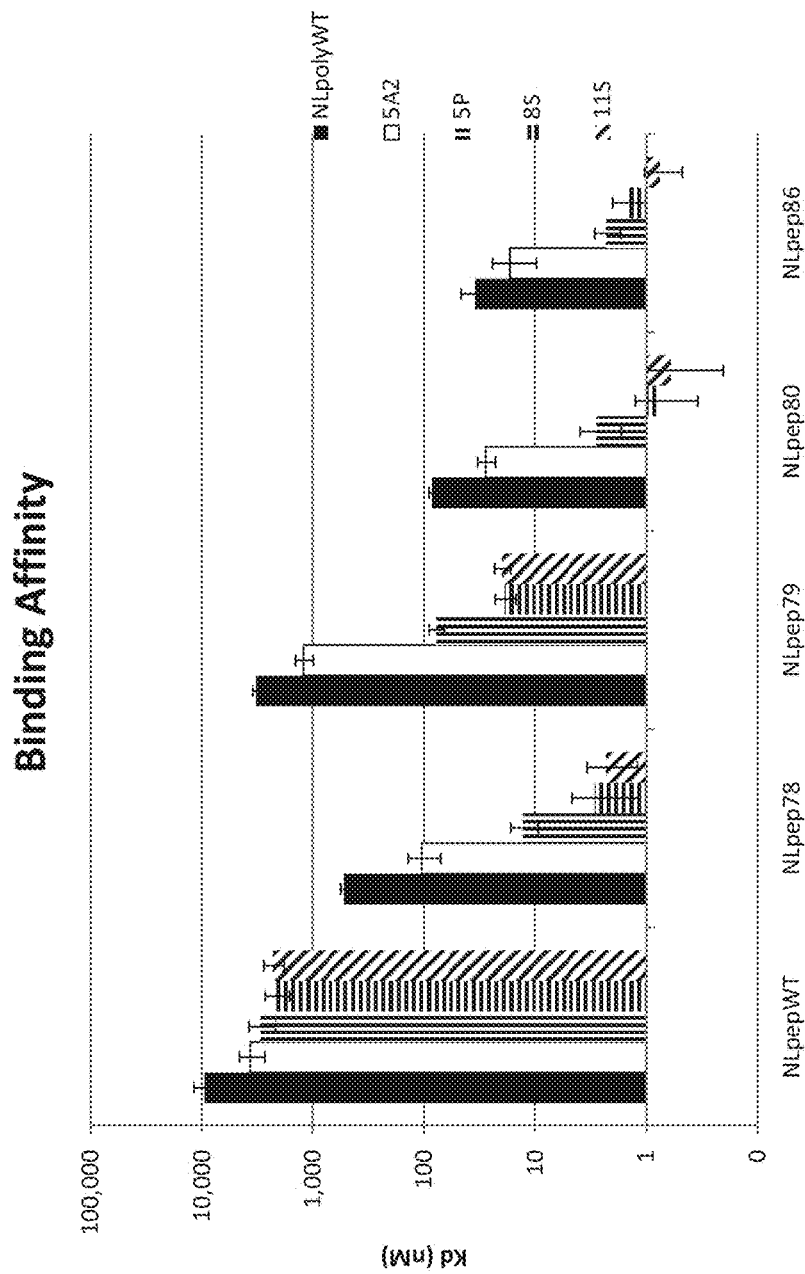
FIG. 103 shows dissociation constants and demonstrates a ~$10^4$ fold improvement in binding affinity from NLpolyWT:NLpepWT to NLpoly11S:NLpep86.

NLpoly WT, 5A2, 5P, 8S or 11 S (*E. coli* clarified lysates) were diluted into PBS+0.1% PRIONEX as follows: WT 1:10$^4$ 5A2 1:105; 5P 1:10$^6$: 8S 1:10$^7$: and 11S 1:10$^7$. NLpepWT, NLpep78, NLpep79 or NLpep80 (synthetic) were serially into PBS+0.1% PRIONEX to 4× concentration. 25 uL NLpoly and 25 uL NLpep were mixed and incubated for 10 min at RT. 50 uL NANOGLO+100 uM Fz was added and incubated for 5 min at RT Luminescence was measured on a GLOMAX Multi+ with 0.5 sec integration. Kd was determined using Graphpad Prism, One Site-Specific Binding, Best-fit values. FIG. 103 illustrates a 10$^4$ fold improved affinity (starting affinity: NLpolyWT:NLpepWT, Kd~10 uM) of $K_d$<1 nM (NLpoly11S:NLpep86 or NLpoly 11S:NLpep80) of the variants tested over wild-type.

Example 62

NLpoly Luminescence

Figure 105:
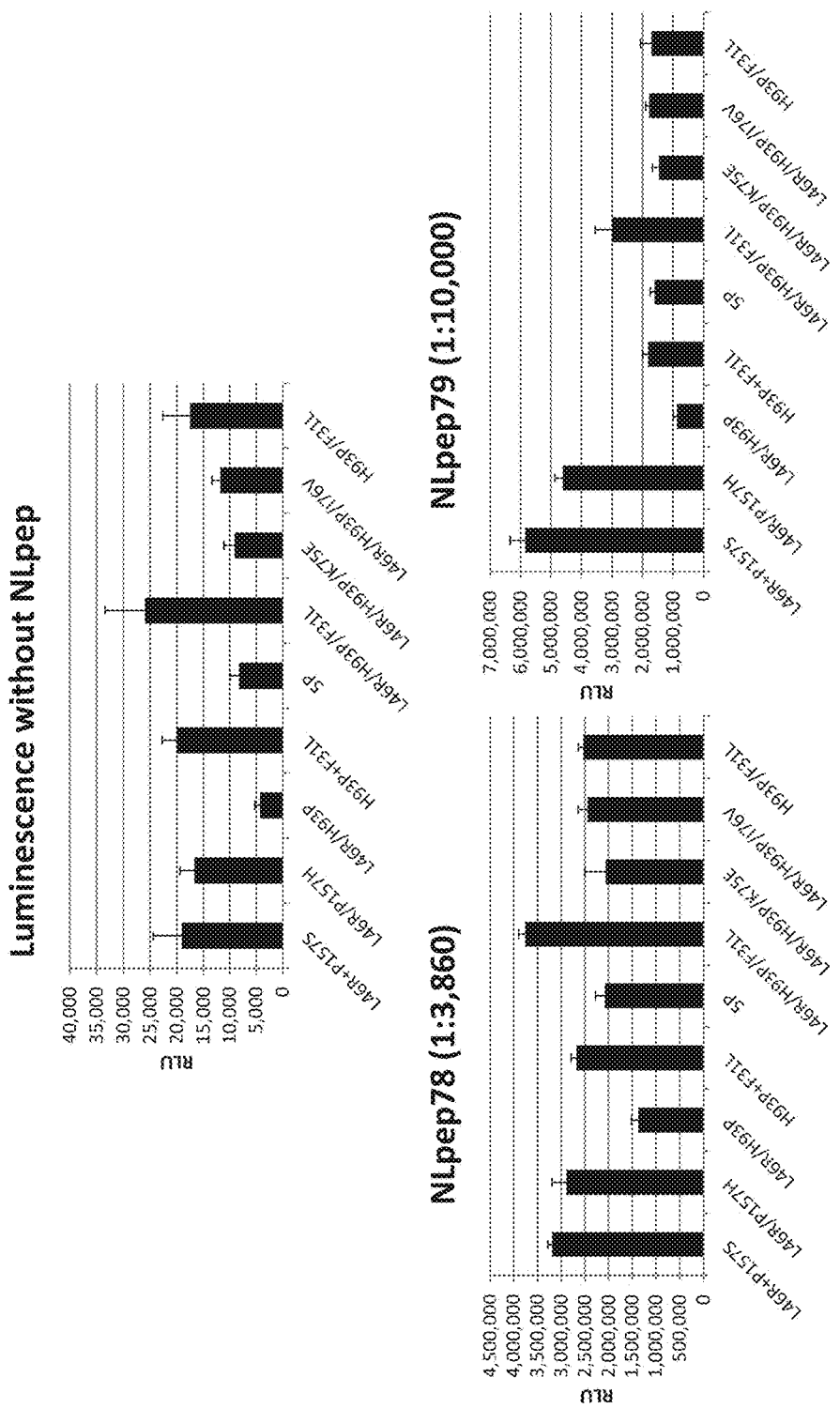
FIG. 105 shows luminescence of various NLpolys in the absence of NLpep and in the presence of NLpep78 and NLpep79.
Figure 106:
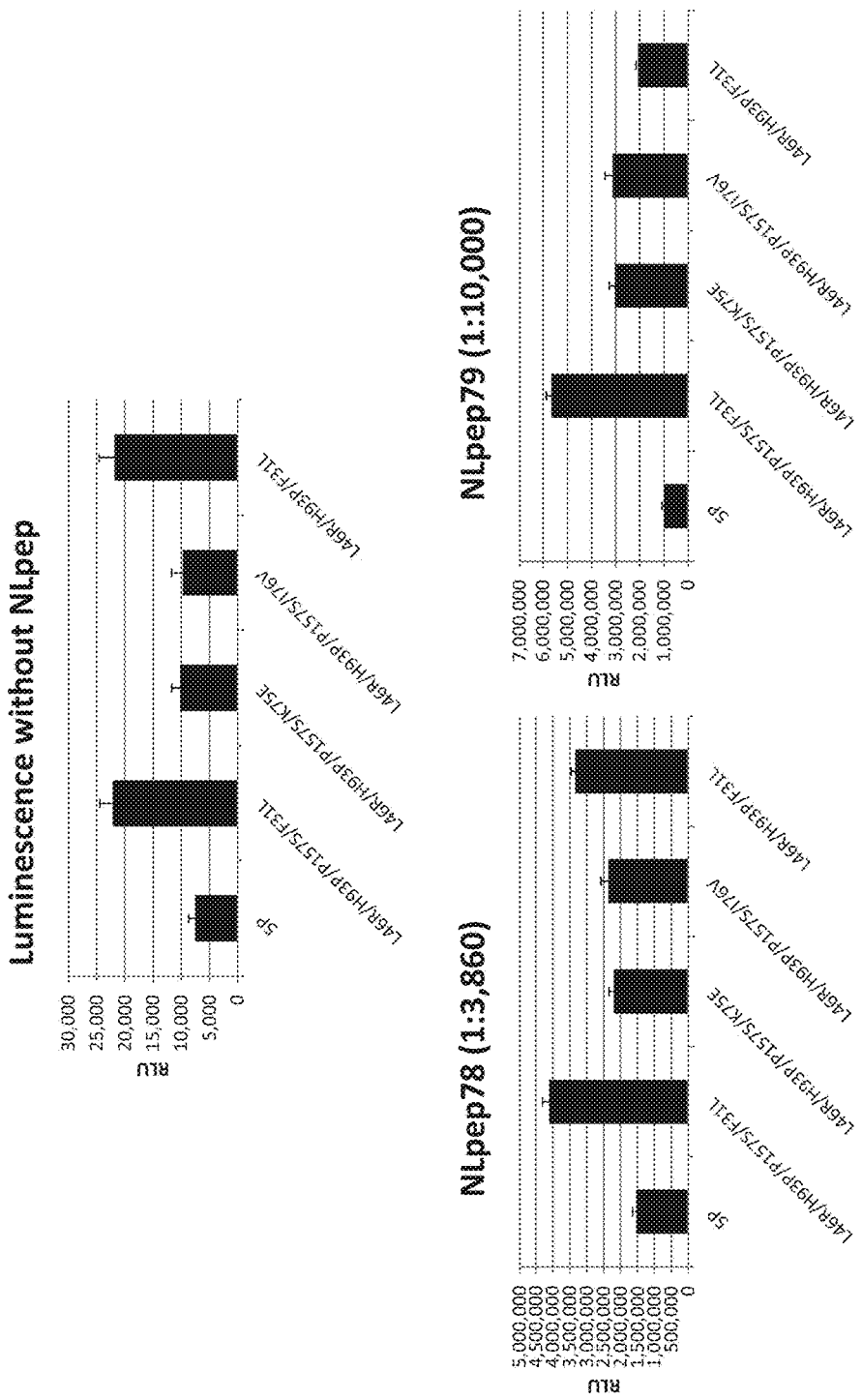
FIG. 106 shows luminescence of various NLpolys in the absence of NLpep and in the presence of NLpep78 and NLpep79.
Figure 107:
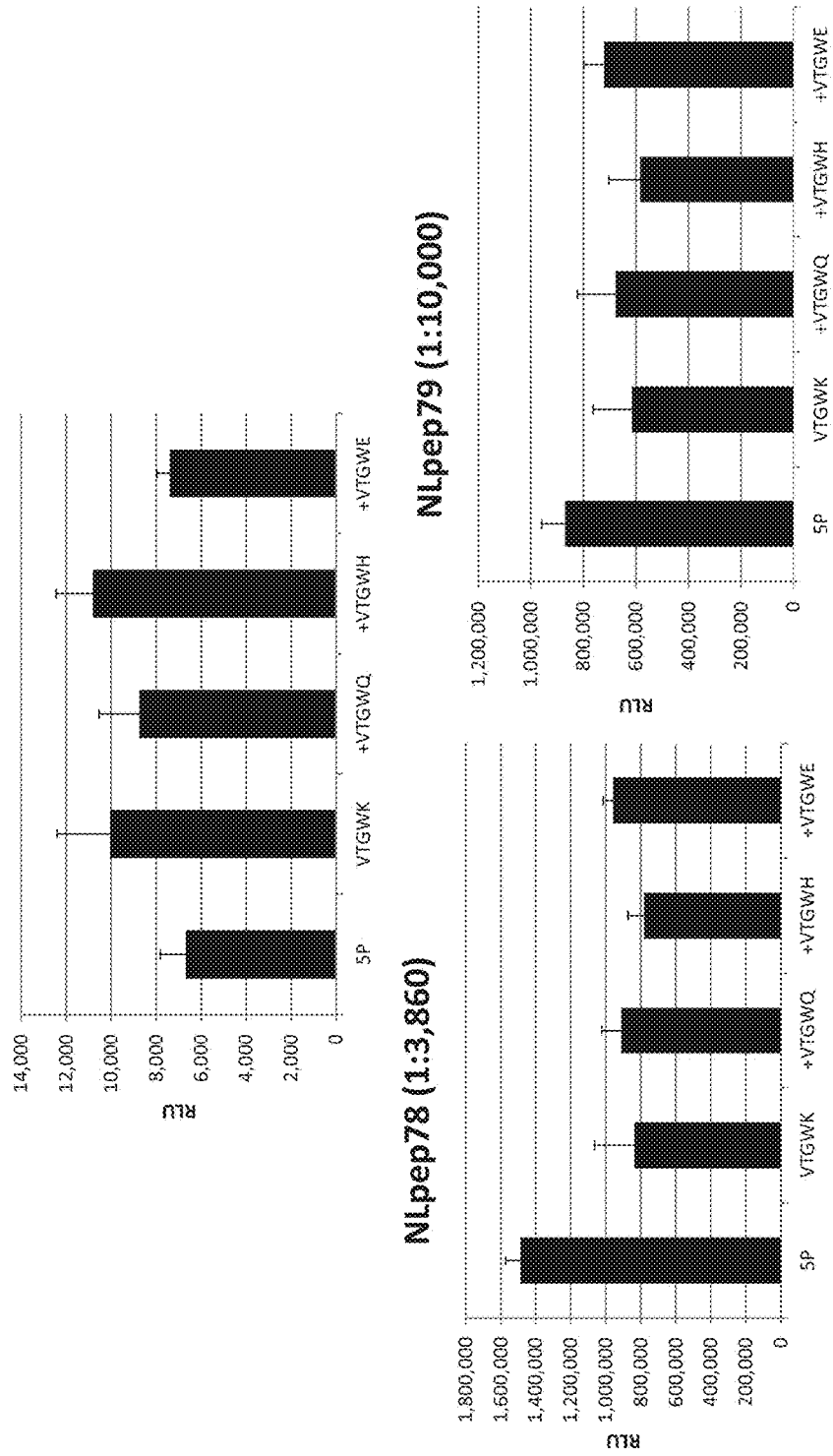
FIG. 107 shows luminescence of various NLpolys in the absence of NLpep and in the presence of NLpep78 and NLpep79.

Single NLpoly variant colonies were inoculated with 200 uL minimal media and grown for 20 hrs at 37° C. on a shaker. 10 uL of the overnight culture were diluted into 190 uL fresh minimal media and grown for 20 hrs at 37° C. on a shaker. 10 uL of this overnight culture was then diluted into 190 uL auto-induction media (previously described) and grown for 18 hrs at 25° C. on a shaker. 10 uL of this expression culture was mixed with 40 uL of assay lysis buffer (previously described) without NLpep or NLpep78-HT (1:3,860 dilution) or NLpep79-HT (1:10,000 dilution) and shaken for 10 min at RT. 50 uL of NANOGLO+Fz was added and again shake for 10 min at RT. Luminescence was measured on GLOMAX luminometer with 0.5 sec integration. FIGS. 105-107 illustrate the luminescence of various NLpolys in the absence of NLpep.

Example 63

Solubility of NLpoly Variants

A single NLpoly variant colony (SEE FIG. 143) was inoculated into 5 mL LB culture and incubated at 37° C. overnight with shaking. The overnight culture was diluted 1:100 into fresh LB and incubated at 37° C. for 3 hrs with shaking. Rhamnose was added to the cultures to 0.2% and incubated 25° C. overnight with shaking. 900 ul of these overnight cultures were mixed with 100 uL 10× FastBreak Lysis Buffer (Promega Corporation) and incubated for 15 min at RT. A 75 uL aliquot (total) was removed from each culture and saved for analysis. The remaining culture from each sample were centrifuged at 14,000×rpm in a benchtop microcentrifuge at 4° C. for 15 min. A 75 uL aliquot of supernatant (soluble) was removed from each sample and saved for analysis. 25 uL of 4×SDS buffer was added to the saved aliquots and incubated at 95° C. for 5 min. 5 ul of each sample was loaded onto a 4-20% Tris-Glycine SDS gel and run at ~190V for ~50 min. The gel was stained with SimplyBlue Safe Stain and imaged on a LAS4000.

FIG. 143 shows a protein gel of total lysates and the soluble fraction of the same lysate for the NLpoly variants.

Example 64

Dissociation Constants

NLpoly variant lysate (SEE FIG. 144; prepared as described previously) was diluted 1:10 into PBS+0.1% PRIONEX. 4× concentrations of NLpep78 (synthetic NLpep78) were made in PBS+0.1% PRIONEX. 20 uL NLpoly variant lysate and 20 uL NLpep were mixed and shaken for 10 min at RT 40 uL NANOGLO/Fz was added and shaken for 10 min at RT. Luminescence was measured on a GLOMAX luminometer with 0.5 s integration. Kd determined using Graphpad Prism. One site-specific binding, best-fit values. FIG. 144 illustrates dissociation constants of NLpep78 with various NLpolys.

Example 65

Comparison of Luminescence Generated by Cells Expressing Different Combinations of FRB and FKBP Fused to NLpoly5P and NLpep80/87

Figure 108:
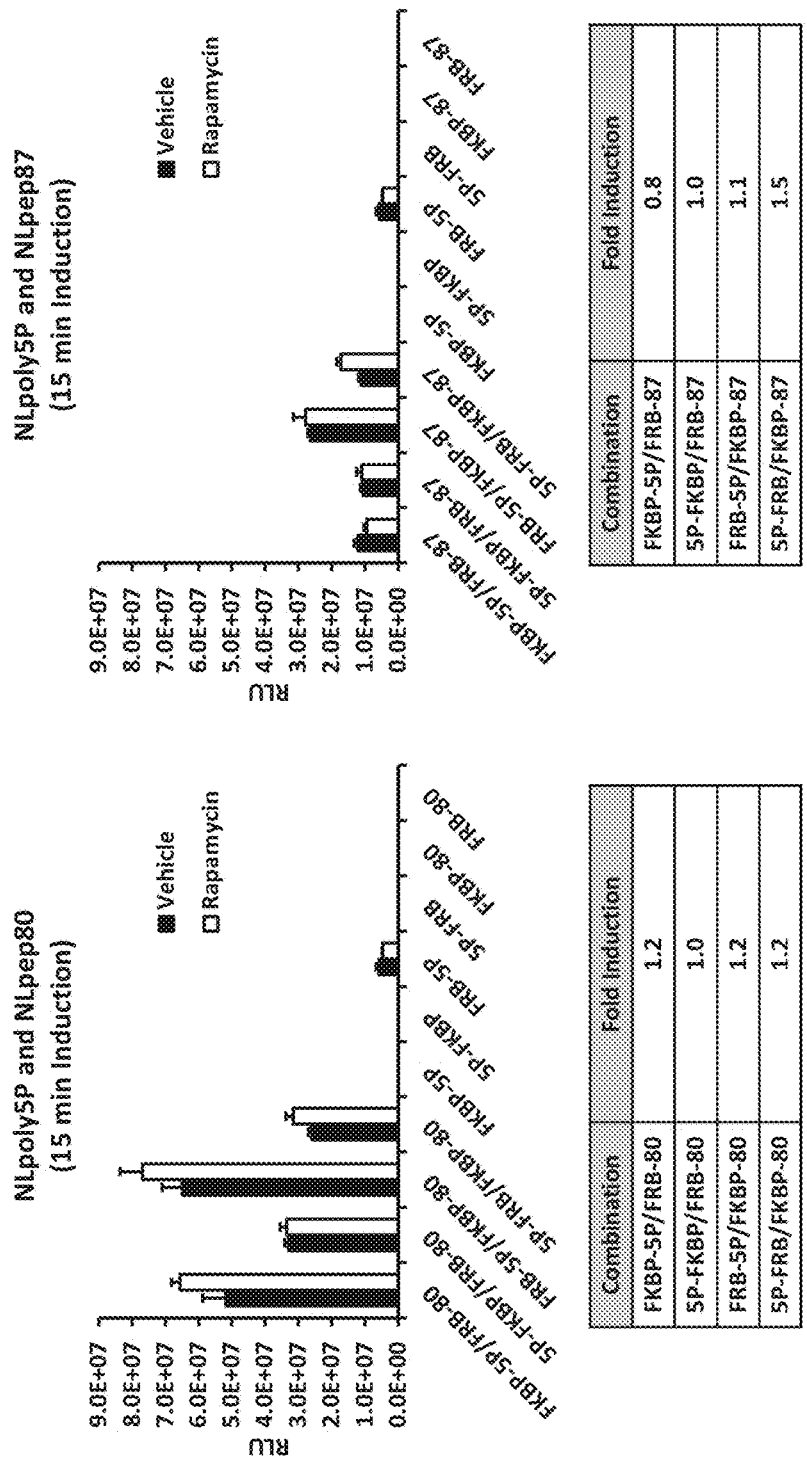
FIG. 108 shows a comparison of luminescence generated by cells expressing different combinations of FRB and FKBP fused to NLpoly5P and NLpep80/87 after 15 min treatment with rapamycin or vehicle. Fold induction refers to signal generated in the presence of rapamycin compared to signal generated with vehicle.
Figure 109:
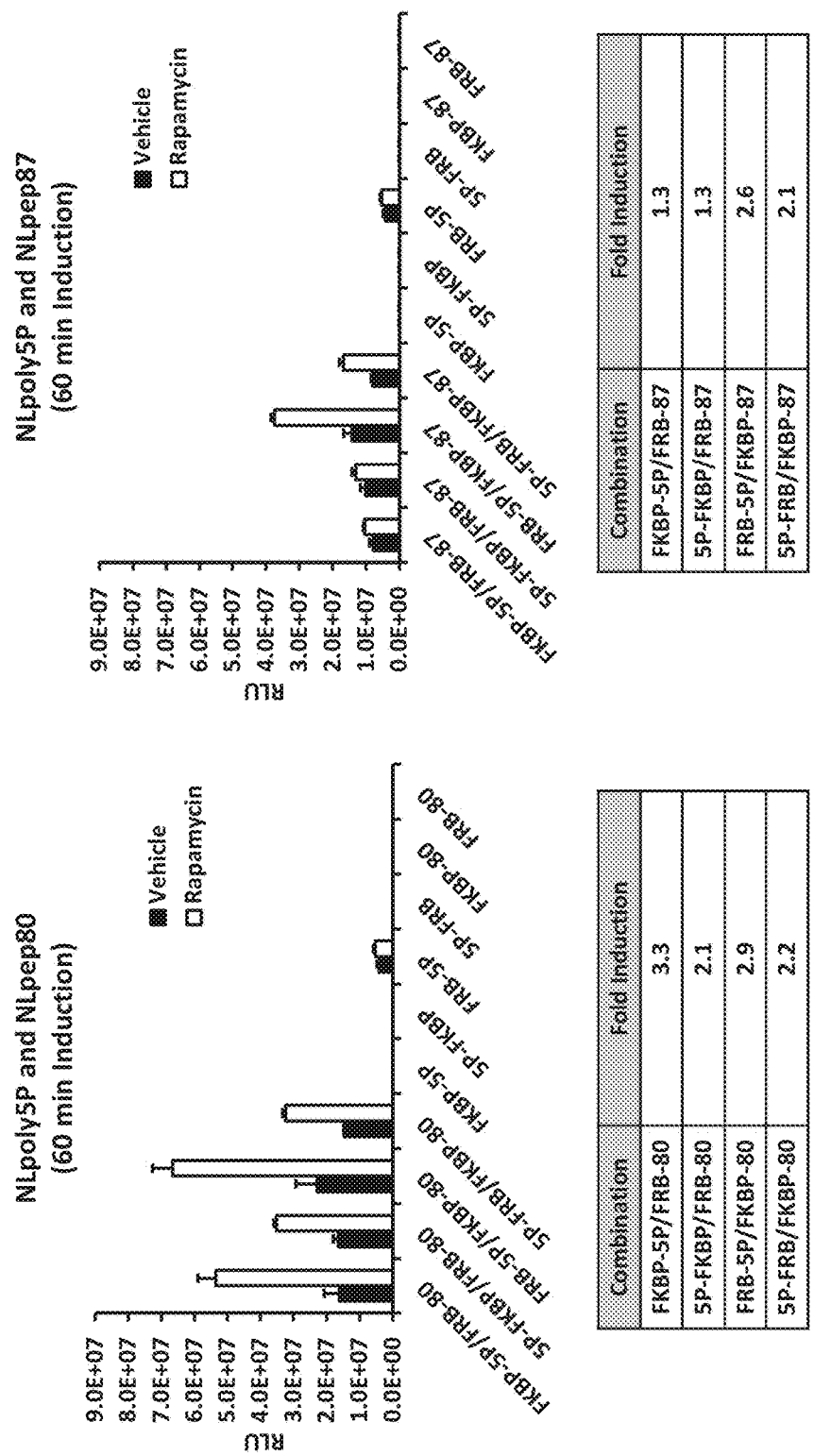
FIG. 109 shows a comparison of luminescence generated by cells expressing different combinations of FRB and FKBP fused to NLpoly5P and NLpep80/87 after 60 min treatment with rapamycin or vehicle.
Figure 110:
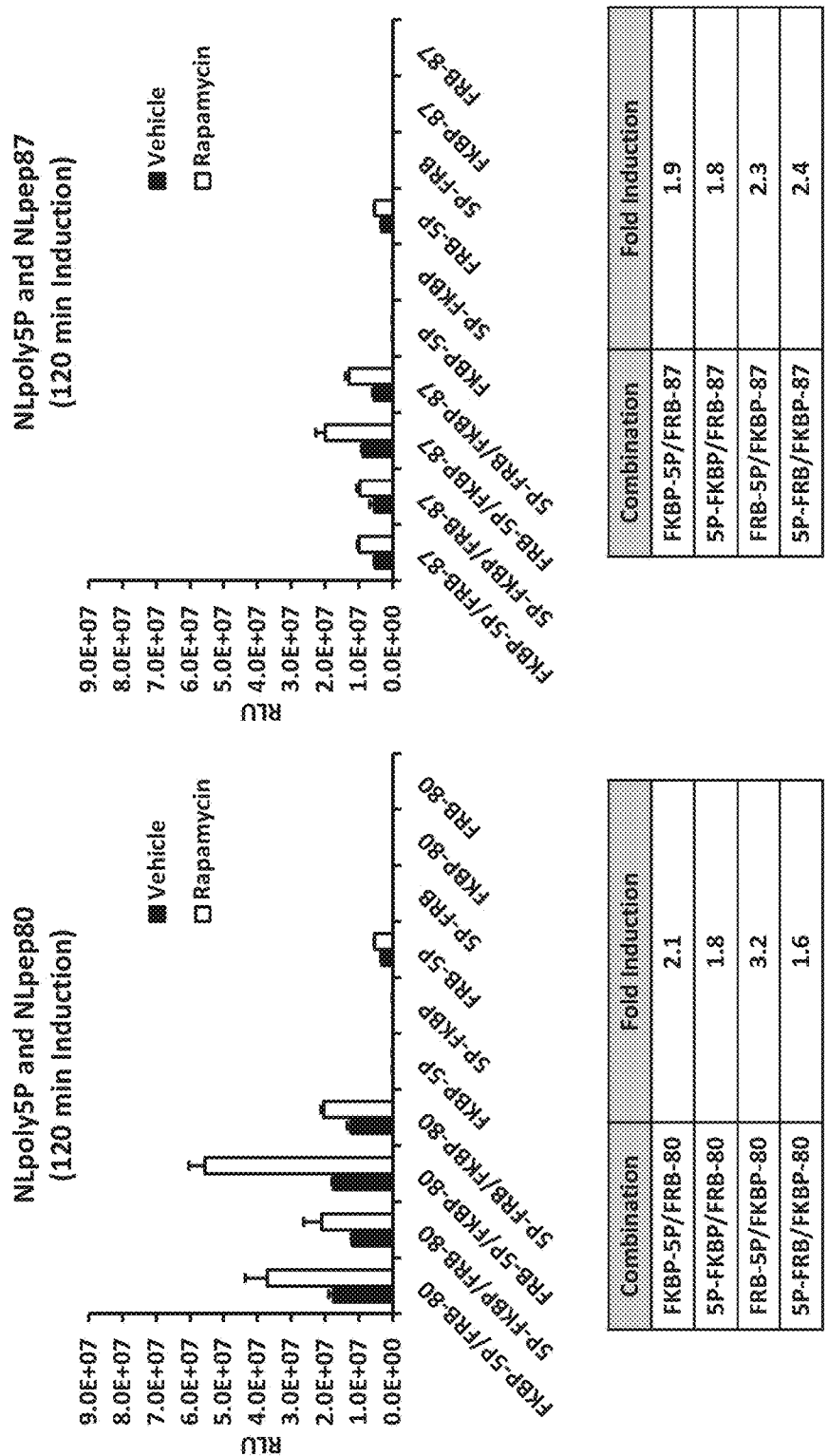
FIG. 110 shows a comparison of luminescence generated by cells expressing different combinations of FRB and FKBP fused to NLpoly5P and NLpep80/87 after 120 min treatment with rapamycin or vehicle.

HEK293T cells (400,000) were reverse-transfected with 1 μg pF4A Ag FKBP or 1 μg pF4A Ag FRB vectors expressing N- or C-terminal fusions of NLpoly5P and/or NLpep80/87 using FuGENE HD at a DNA-to-FuGENE HD ratio of 1:4. 24-hours post transfection, cells were trypsinized and re-plated in opaque 96-well assay plates at a density of 10.000 cells per well. 24-hours after plating, cells were washed with PBS and then incubated with or without 20 nM rapamycin for 15, 60 or 120 min in phenol red-free OptiMEMI. 10 μM furimazine substrate with or without 20 nM rapamycin in OptiMEM was added directly to each well and incubated at room temperature for 5 min. Luminescence was then measured on a GLOMAX Multi with 0.5 s integration time. FIG. 108 (15 min induction), 109 (60 min induction) and 110 (120 min induction) illustrate a general increase in induction over time, with NLpoly5P and NLpep80 combinations generating the most luminescence. Individual components contribute minimally to signal.

Example 66

Comparison of Luminescence Generated by Cells Expressing Different Combinations of FRB and FKBP Fused to NLpoly5P and NLpep80/87

Figure 111:
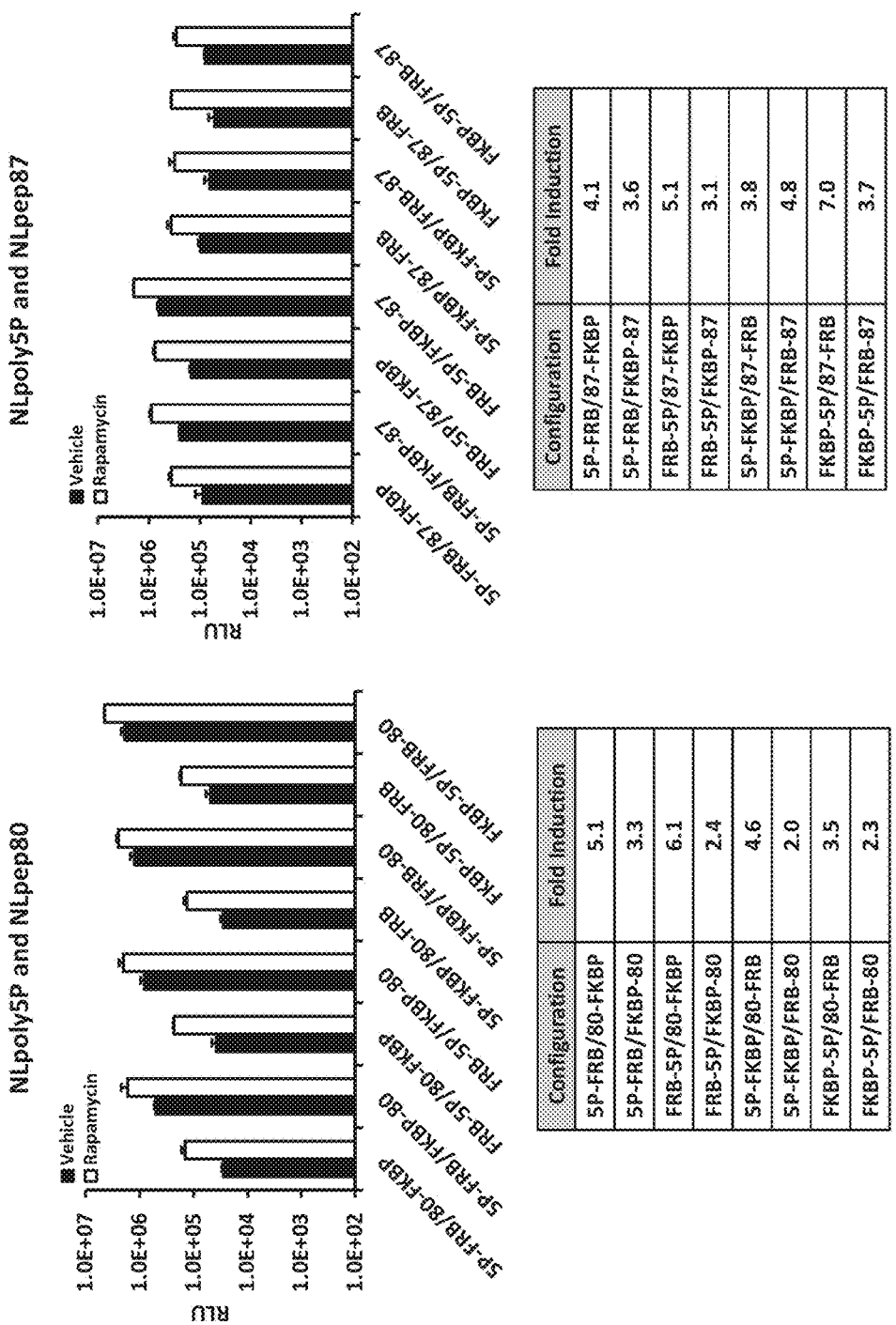
FIG. 111 shows a comparison of luminescence generated by cells expressing different combinations of FRB and FKBP fused to NLpoly5P and NLpep80/87 after 120 min treatment with rapamycin or vehicle. All 8 possible combinations of FRB and FKBP fused to NLpoly/NLpep were tested and less total DNA was used.

Although similar to Example 65, this example tested all 8 possible combinations of FRB and FKBP fused to NLpoly/NLpep as well as used less total DNA. HEK293T cells (400,000) were reverse-transfected with a total of 0.001 μg pF4A Ag FRB-NLpoly5P and 0.001 μg pF4A Ag FKBP-NLpep80/NLpep87 using FuGENE HD at a DNA-to-FuGENE ratio of 1 to 8. pGEM-3Zf(+) DNA was added to bring total DNA in each transfection to 1 μg. 24-hours post-transfection, 10,000 cells were re-plated in opaque 96-well assay plates and incubated an additional 24 hours. Cells were washed with PBS and then incubated in phenol red-free OptiMEMI with 0 or 50 nM rapamycin for 2 h. 10 μM furimazine substrate (final concentration on cells) with 0 or 50 nM rapamycin in OptiMEM was added directly to each well and incubated at room temperature for 5 min. Luminescence was then measured on a GLOMAX Multi with 0.5 s integration time. FIG. 111 illustrates that NLpep80 combinations generated the highest luminescence and that all configurations respond to rapamycin treatment.

Example 67

Figure 112:
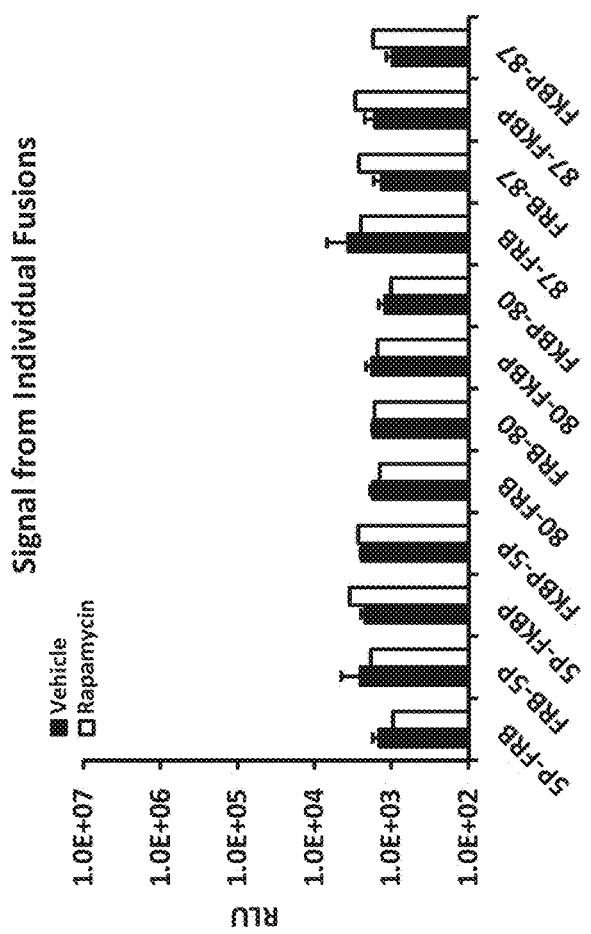
FIG. 112 shows a comparison of luminescence generated by FRB or FKBP fusions expressed in the absence of binding partner.

Comparison of Luminescence Generated by FRB or FKBP Fusions Expressed in the Absence of Binding Partner HEK293T cells (400,000) were reverse-transfected with a total of 0.001 μg pF4A Ag FRB-NLpoly5P or pF4A Ag FKBP-NLpoly/NLpep87 using FuGENE HD at a DNA-to-FuGENE ratio of 1 to 8. pGEM-3Zf(+) DNA was added to bring total DNA in each transfection to 1 μg. 24-hours post-transfection, 10,000 cells were re-plated in opaque 96-well assay plates and incubated an additional 24 hours. Cells were washed with PBS and then incubated in phenol red-free OptiMEMI with 0 or 50 nM rapamycin for 2 h. 10 μM furimazine substrate (final concentration on cells) with 0 or 50 nM rapamycin in OptiMEM was added directly to each well and incubated at room temperature for 5 min. Luminescence was then measured on a GLOMAX Multi with 0.5 s integration time. FIG. 112 illustrates that the individual components generate a low basal level of luminescence that is not responsive to rapamycin treatment.

Example 68

Figure 113:
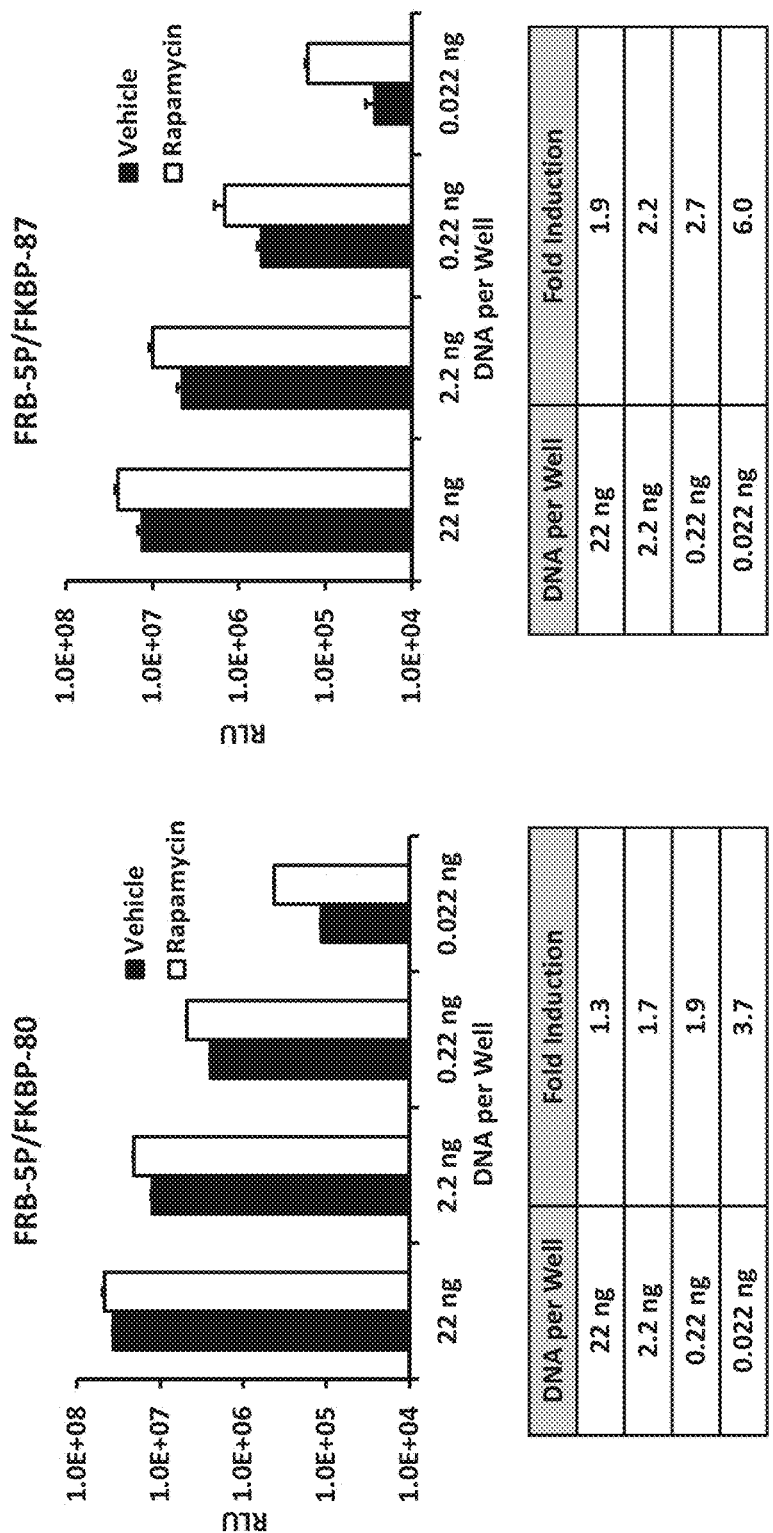
FIG. 113 shows a comparison of luminescence generated by cells transfected with varying amounts of FRB-NLpoly5P and FKBP-NLpep80/87 DNA.

Comparison of Luminescence Generated by Cells Transfected with Varying Amounts of FRB-NLpoly5P and FKBP-NLpep80/87 DNA HEK293T (400,000) cells were reverse-transfected with a total of 2, 0.2, 0.02, or 0.002 μg pF4A Ag FRB-NLpoly5P and pF4A Ag FKBP-NLpep80 using FuGENE HD at a DNA-to-FuGENE ratio of 1 to 4. pGEM-3Zf(+) DNA was added to bring total DNA in each transfection to 2 µg. 24-hours post-transfection, 10.000 cells were re-plated in opaque 96-well assay plates and incubated an additional 24 hours. Cells were washed with PBS and then incubated in phenol red-free OptiMEMI with or without 20 nM rapamycin for 2 h. 10 µM furimazine substrate (final concentration on cells) with or without 20 nM rapamycin in OptiMEM was added directly to each well and incubated at room temperature for 5 min. Luminescence was then measured on a GLOMAX Multi with 0.5 s integration time. FIG. 113 illustrates that transfection with less DNA decreases overall luminescence but increases fold induction.

Example 69

Figure 114:
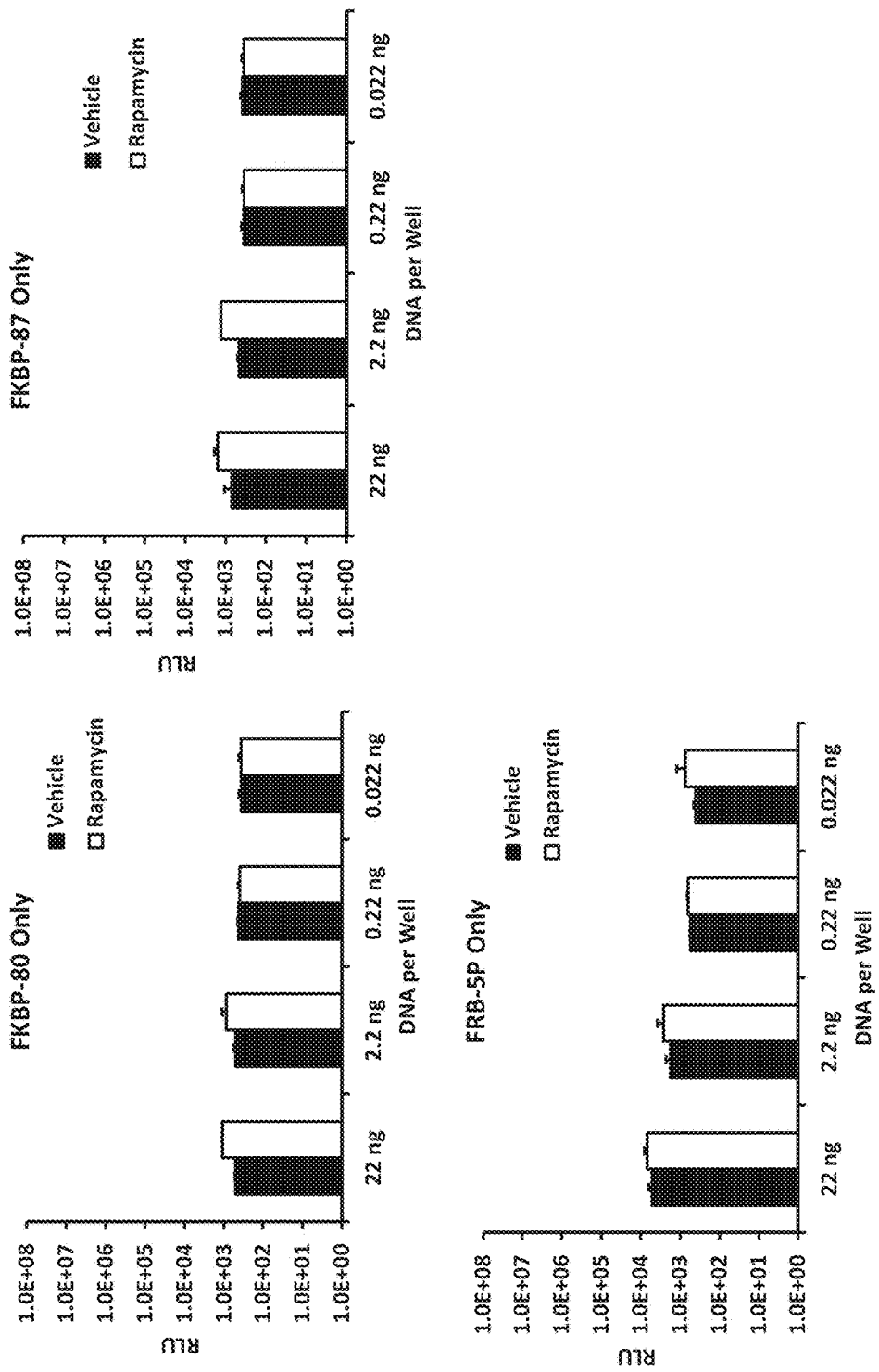
FIG. 114 shows a comparison of luminescence generated by cells transfected with varying amounts of FRB-NLpoly5P or FKBP-NLpep80/87 DNA in the absence of binding partner.

Comparison of Luminescence Generated by Cells Transfected with Varying Amounts of FRB-NLpoly5P or FKBP-NLpep80/87 DNA in the Absence of Binding Partner HEK293T cells (400,000) were reverse-transfected with a total of 2, 0.2, 0.02, or 0.002 µg pF4A Ag FRB-NLpoly5P or pF4A Ag FKBP-NLpep80 using FuGENE HD at a DNA-to-FuGENE ratio of 1 to 4. pGEM-3Zf(+) DNA was added to bring total DNA in each transfection to 2 µg. 24-hours post-transfection, 10,000 cells were replated in opaque 96-well assay plates and incubated an additional 24 hours. Cells were washed with PBS and then incubated in phenol red-free OptiMEMI with or without 20 nM rapamycin for 2 h. 10 µM furimazine substrate (final concentration on cells) with or without 20 nM rapamycin in OptiMEM was added directly to each well and incubated at room temperature for 5 min. Luminescence was then measured on a GLOMAX Multi with 0.5 s integration time. FIG. 114 illustrates that lower DNA levels do not change overall luminescence of cells transfected with individual components.

Example 70

Figure 115:
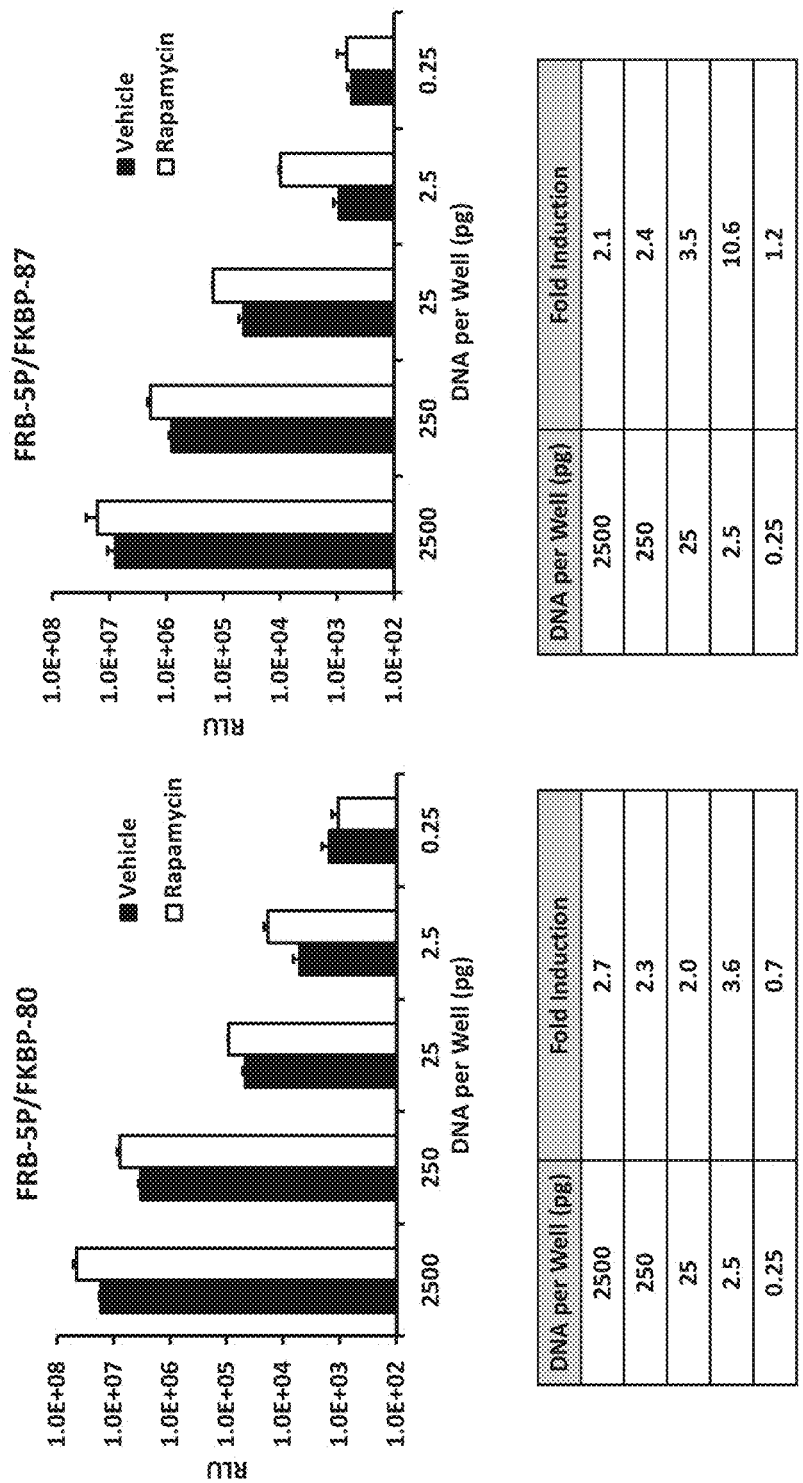
FIG. 115 shows a comparison of luminescence generated by cells transfected with varying amounts of FRB-NLpoly5P and FKBP-NLpep80/87 DNA. This example differs from FIG. 113 in that lower levels of DNA were used.

Comparison of Luminescence Generated by Cells Transfected with Varying Amounts of FRB-NLpoly5P and FKBP-NLpep80/87 DNA HEK293T cells (400.000) were reverse-transfected with a total of 0.2, 0.02, 0.002, or 0.0002 µg pF4A Ag FRB-NLpoly5P and pF4A Ag FKBP-NLpep80, NLpep87 using FuGENE HD at a DNA-to-FuGENE ratio of 1 to 4. pGEM-3Zf(+) DNA was added to bring total DNA in each transfection to 2 µg. 24-hours post-transfection, 10,000 cells were re-plated in opaque 96-well assay plates and incubated an additional 24 hours. Cells were washed with PBS and then incubated in phenol red-free OptiMEMI with or without 50 nM rapamycin for 2 h. 10 µM furimazine substrate (final concentration on cells) with or without 50 nM rapamycin in OptiMEM was added directly to each well and incubated at room temperature for 5 min. Luminescence was then measured on a GLOMAX Multi with 0.5 s integration time. FIG. 115 illustrates that luminescence above background, as determined in Examples 69 and 71, and rapamycin induction can be achieved with DNA levels down to 2.5 µg.

Example 71

Figure 116:
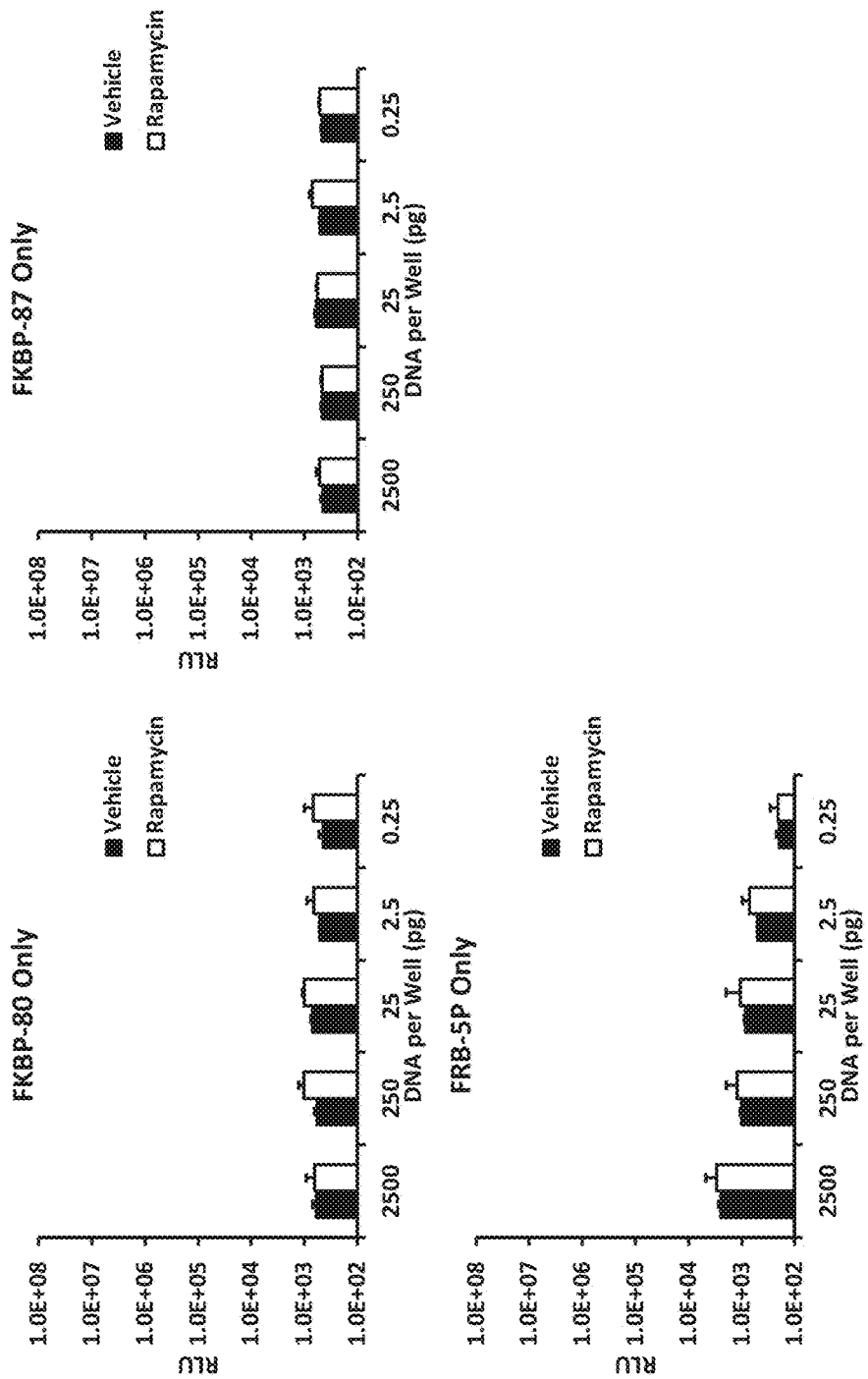
FIG. 116 shows a comparison of luminescence generated by cells transfected with varying amounts of FRB-NLpoly5P or FKBP-NLpep80/87 DNA in the absence of binding partner. This differs from FIG. 114 in that lower levels of DNA were used.

Comparison of Luminescence Generated by Cells Transfected with Varying Amounts of FRB-NLpoly5P or FKBP-NLpep80/87 DNA in the Absence of Binding Partner HEK293T cells (400,000) were reverse-transfected with a total of 0.2, 0.02, 0.002, or 0.0002 µg pF4A Ag FRB-NLpoly5P or pF4A Ag FKBP-NLpep80/NLpep87 using FuGENE HD at a DNA-to-FuGENE ratio of 1 to 4. pGEM-3Zf(+) DNA was added to bring total DNA in each transfection to 2 µg. 24-hours post-transfection, 10,000 cells were re-plated in opaque 96-well assay plates and incubated an additional 24 hours. Cells were washed with PBS and then incubated in phenol red-free OptiMEMI with or without 50 nM rapamycin for 2 h. 10 µM furimazine substrate (final concentration on cells) with or without 50 nM rapamycin in OptiMEM was added directly to each well and incubated at room temperature for 5 min. Luminescence was then measured on a GLOMAX Multi with 0.5 s integration time. FIG. 116 illustrates no significant change in luminescence generated by individual components when less DNA was used.

Example 72

Figure 117:
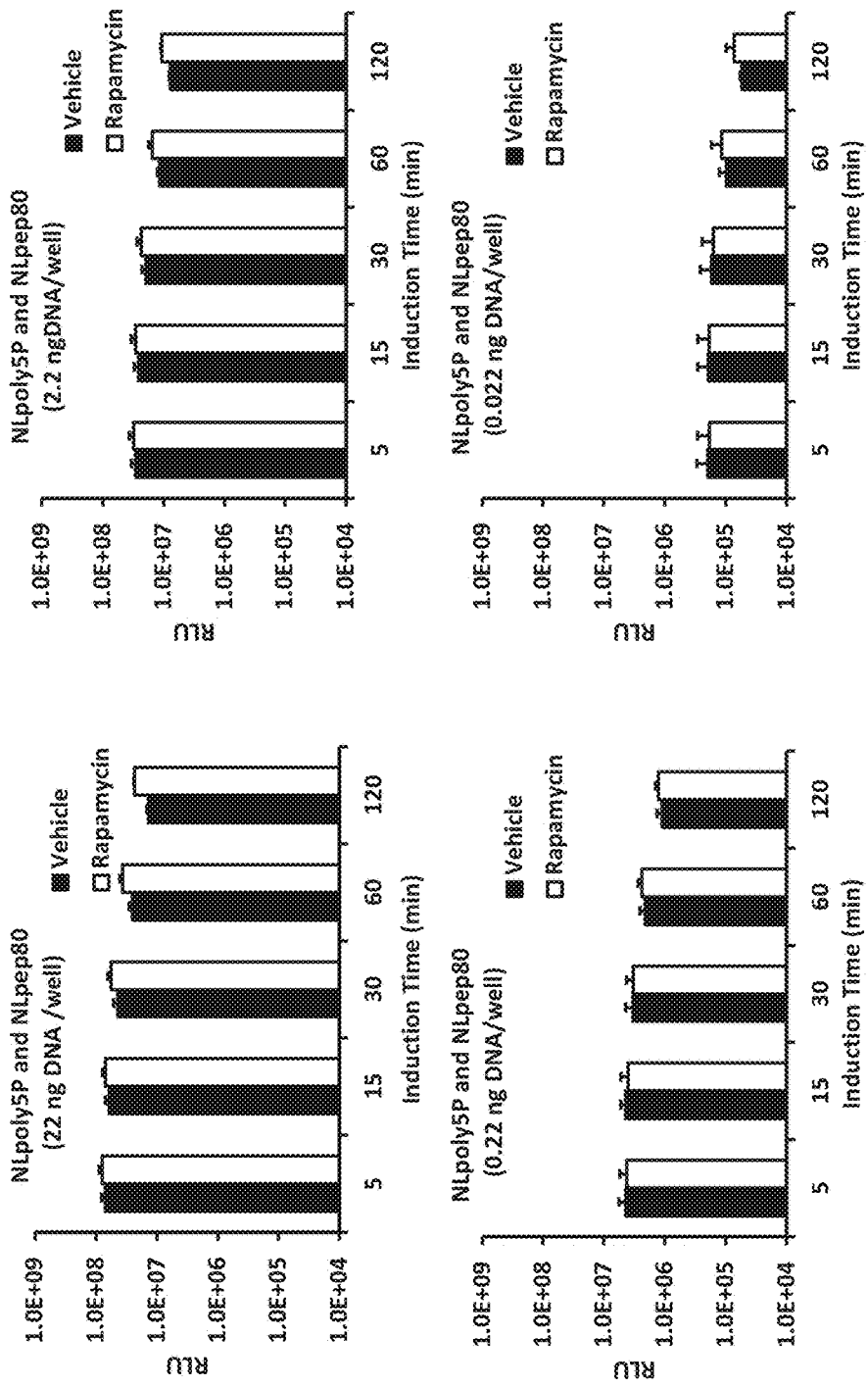
FIG. 117 shows a comparison of luminescence generated by cells transfected with varying amounts of FRB-NLpoly5P and FKBP-NLpep80 DNA after treatment with rapamycin for different lengths of time.
Figure 118:
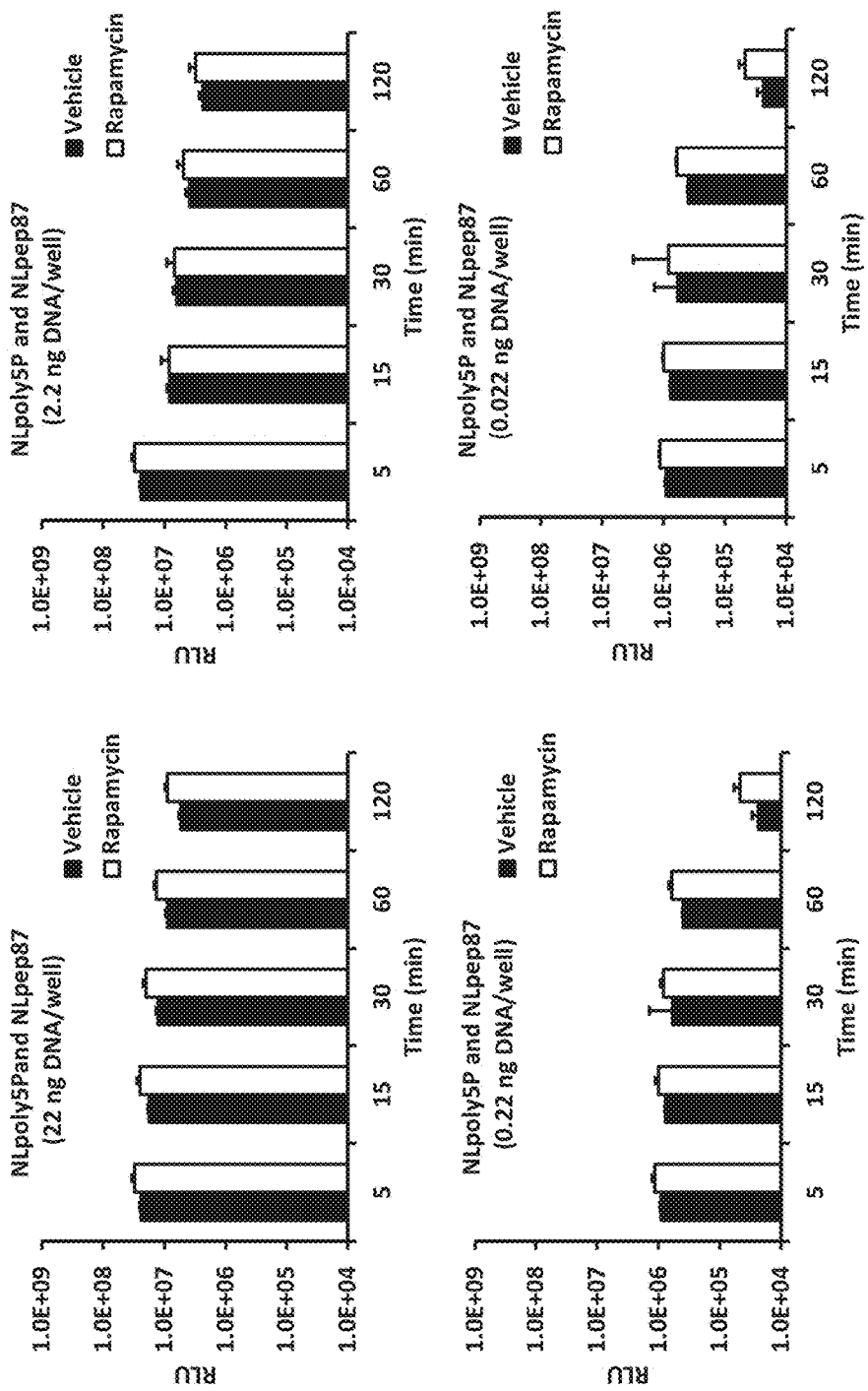
FIG. 118 shows a comparison of luminescence generated by cells transfected with varying amounts of FRB-NLpoly5P and FKBP-NLpep87 DNA after treatment with rapamycin for different lengths of time.

Comparison of Luminescence Generated by Cells Transfected with Varying Amounts of FRB-NLpoly5P and FKBP-NLpep80 or FKBP-NLpep87 DNA after Treatment with Rapamycin for Different Lengths of Time HEK293T cells (400.000) were reverse-transfected with a total of 2, 0.2, 0.02, or 0.002 µg pF4A Ag FRB-NLpoly5P and pF4A Ag FKBP-NLpep80 or FKBP-NLpep87 using FuGENE HD at a DNA-to-FuGENE ratio of 1 to 4. pGEM-3Zf(+) DNA was added to bring total DNA in each transfection to 2 µg. 24-hours post-transfection, 10,000 cells were re-plated in opaque 96-well assay plates and incubated an additional 24 hours. Cells were washed with PBS and then incubated in phenol red-free OptiMEMI with or without 20 nM rapamycin for 5/15/30/60/120 min. 10 µM furimazine substrate (final concentration on cells) with or without 20 nM rapamycin in OptiMEM was added directly to each well and incubated at room temperature for 5 min. Luminescence was then measured on a GLOMAX Multi with 0.5 s integration time. FIGS. 117 and 118 illustrates a decline in luminescence with less DNA and an increase in rapamycin induction over time.

Example 73

Comparison of Luminescence Generated by Cells Expressing Different Combinations of FRB-NLpoly5P or FRB-NLpoly5A2 with FKBP-NLpep80/87/95/96/97

In this example, the assay was performed in both a two-day and three-day format. For the 2 day assay, 20,000 HEK293T cells were reverse-transfected in opaque 96-well assay plates with a total of 0.1 ng pF4A Ag FRB-NLpoly5P or FRB-NLpoly5A2 and pF4A Ag FKBP-NLpep80/87/95/96/97 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then incubated in phenol red-free OptiMEMI with or without 50 nM rapamycin for 2 h.

10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time.

Figure 119:
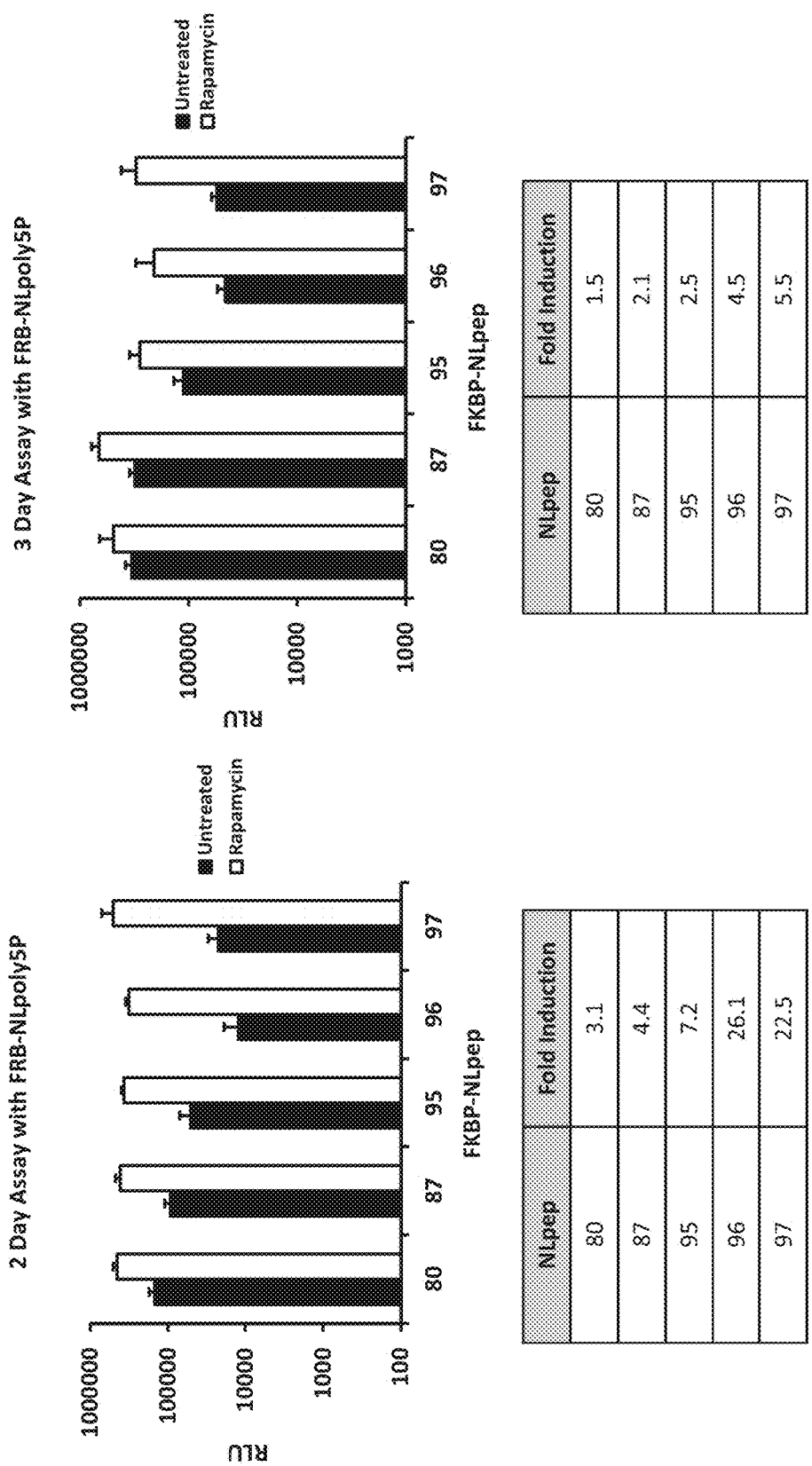
FIG. 119 shows a comparison of luminescence generated by cells expressing different combinations of FRB-NLpoly5P with FKBP-NLpep80/87/95/96/97. Assay was performed in both a two-day and three-day format.
Figure 120:
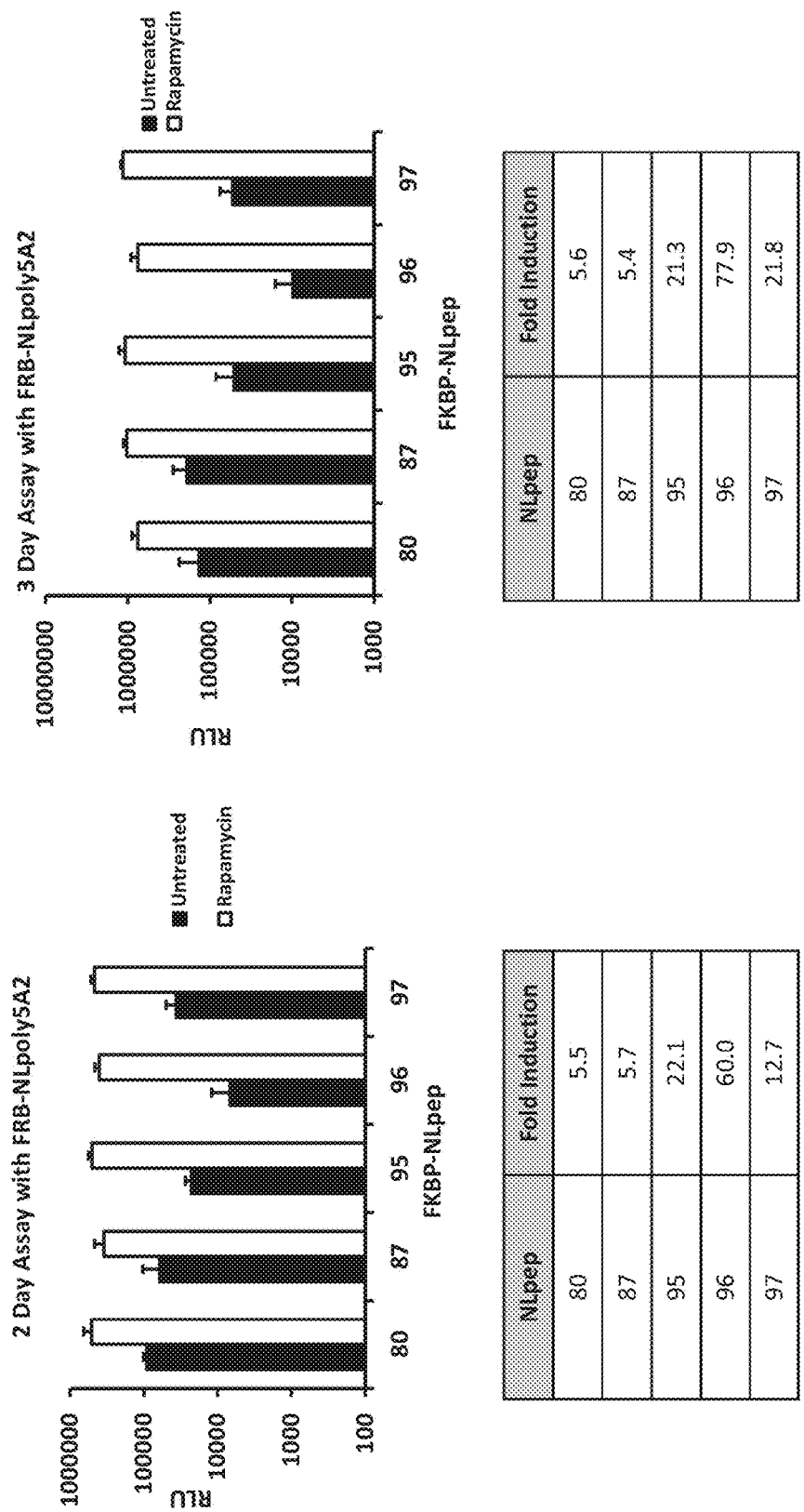
FIG. 120 shows a comparison of luminescence generated by cells expressing different combinations of FRB-NLpoly5A2 with FKBP-NLpep80/87/95/96/97. Assay was performed in both a two-day and three-day format.

For 3 day assay, 400,000 HEK293T cells were reverse-transfected with a total of 0.002 μg pF4A Ag FRB-NLpoly5P and pF4A Ag FKBP-NLpep80/87/95/96/97 using FuGENE HD at a DNA-to-FuGENE ratio of 1 to 8. pGEM-3Zf(+) DNA was added to bring total DNA in each transfection to 1 μg. 24-hours post-transfection, 10,000 cells were re-plated in opaque 96-well assay plates and incubated an additional 24 hours. Cells were washed with PBS and then incubated in phenol red-free OptiMEMI with or without 50 nM rapamycin for 2 h. 10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time. FIGS. 119 and 120 illustrate similar levels of luminescence in both the 2 day and 3 day assays. Assays performed with NLpoly5A2 showed greater rapamycin induction relative to NLpoly5P, and assays performed with NLpoly5A2 and NLpep96 showed greatest rapamycin induction of all tested combinations.

Example 73

Comparison of Luminescence Generated by Cells Expressing Different Combinations of FRB-NLpoly5A2 or FRB-NLpoly11S with FKBP-NLpep101/104/105/106/107/108/109/110

Figure 121:
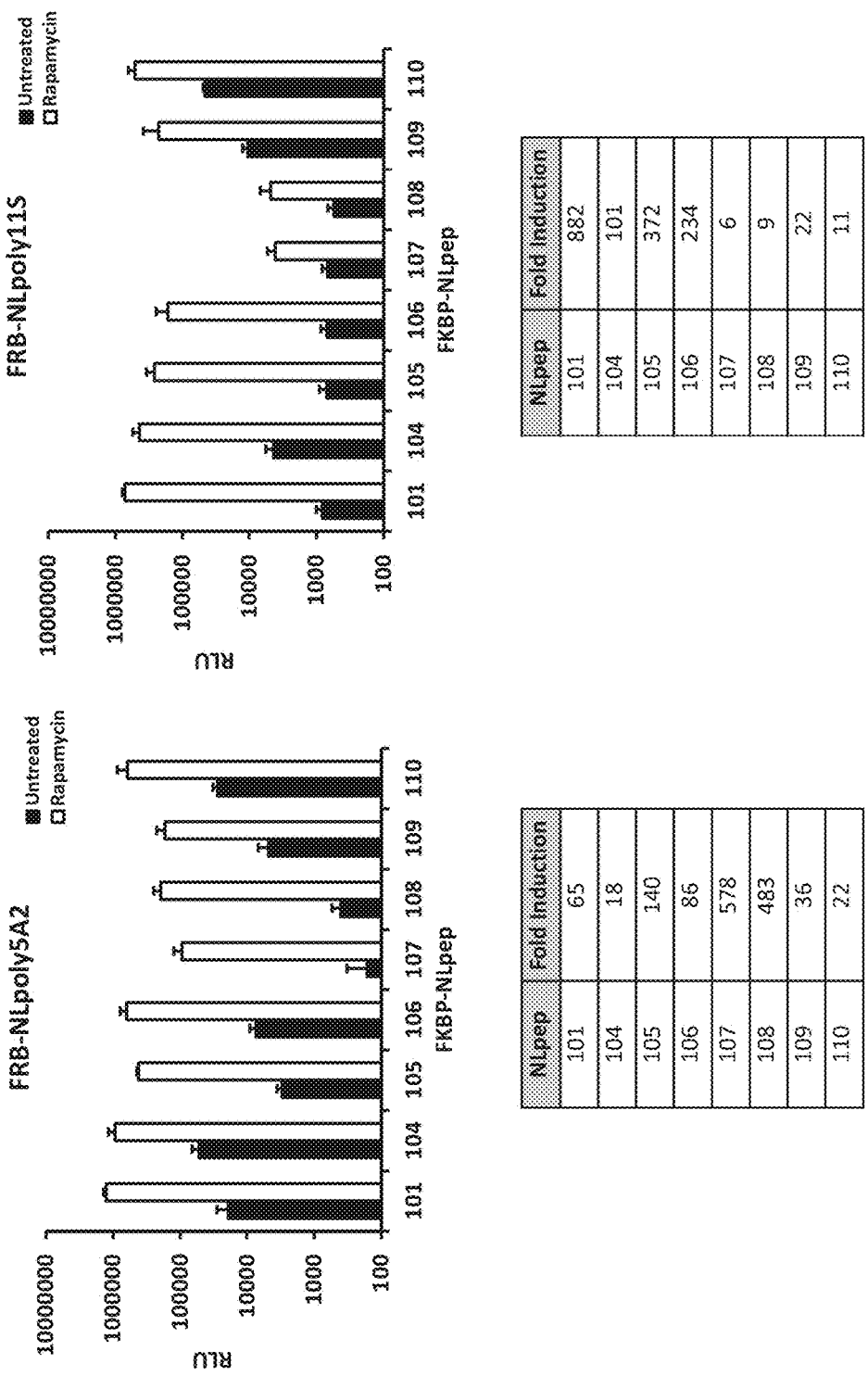
FIG. 121 shows a comparison of luminescence generated by cells expressing different combinations of FRB-NLpoly5A2 or FRB-NLpoly11S with FKBP-NLpep101/104/105/106/107/108/109/110.

HEK293T cells (20,000) were reverse-transfected in opaque 96-well assay plates with a total of 0.1 ng pF4A Ag FRB-NLpoly5A2/11S and pF4A Ag FKBP-NLpep101/104/105/106/107/108/109/110 using FuGENE HD at a DNA-to-FuGENE ratio of 1 to 8. pGEM-3Zf(+) DNA was added to bring total DNA in each transfection to 1 μg. 24 hours-post transfection, cells were washed with PBS and then incubated in phenol red-free OptiMEMI with or without 50 nM rapamycin for 2 h. 10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time. FIG. 121 illustrates that, of tested combinations, NLpoly11S with NLpep101 showed the greatest rapamycin induction and one of the strongest rapamycin-specific luminescent signals.

Example 74

Comparison of Luminescence Generated by Cells Transfected with Different Combinations of FRB-NLpoly5A2 or FRB-NLpoly11S with FKBP-NLpep87/96/98/99/100/101/102/103

Figure 122:
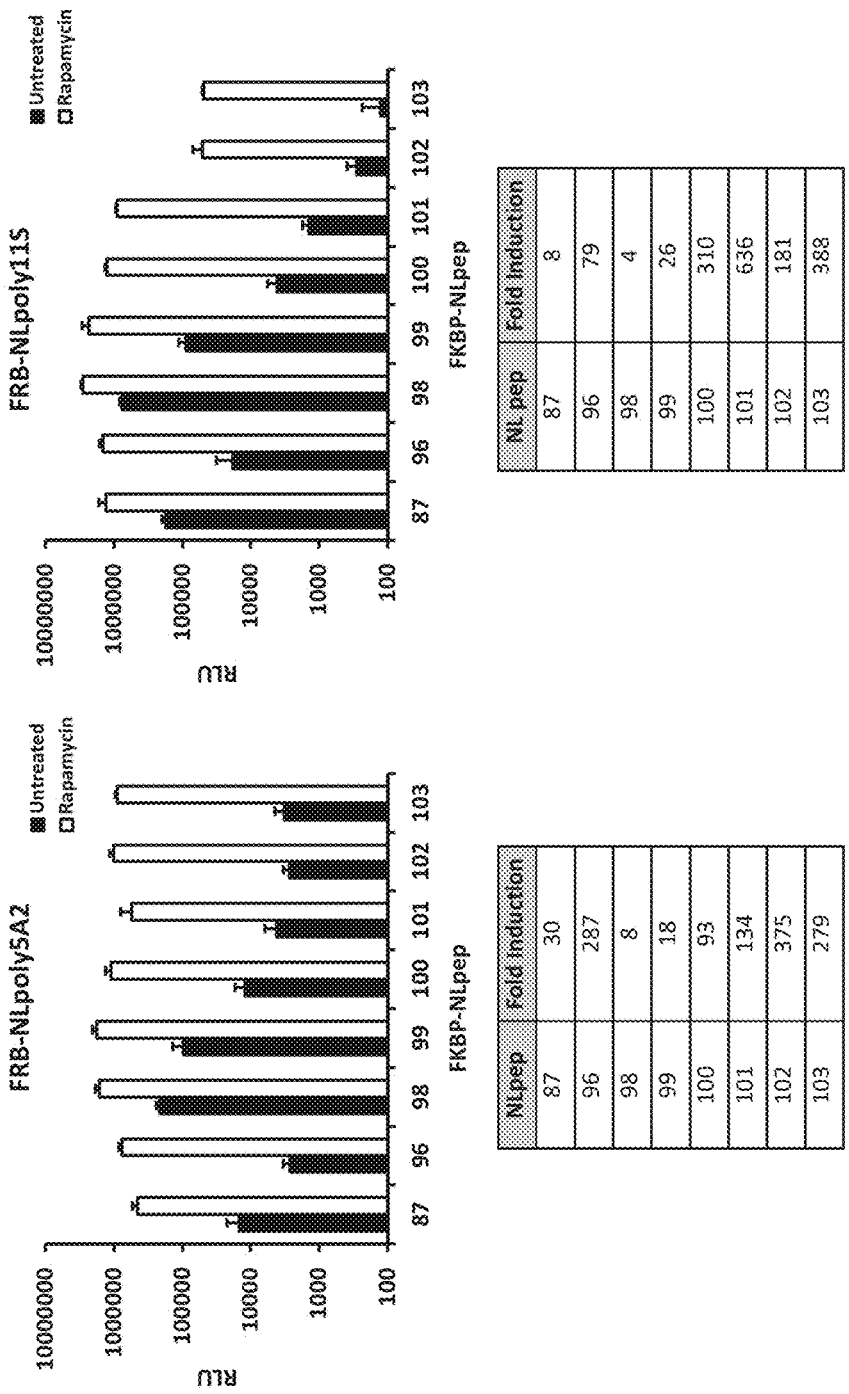
FIG. 122 shows a comparison of luminescence generated by cells transfected with different combinations of FRB-NLpoly5A2 or FRB-NLpoly11S with FKBP-NLpep87/96/98/99/100/101/102/103.

HEK293T cells (20,000) were reverse-transfected in opaque 96-well assay plates with a total of 0.1 ng pF4A Ag FRB-NLpoly5A2/11S and pF4A Ag FKBP-NLpep87/96/98/99/100/101/102/103 using FuGENE HD at a DNA-to-FuGENE ratio of 1 to 8. pGEM-3Zf(+) DNA was added to bring total DNA in each transfection to 1p g. 24 hours-post transfection, cells were washed with PBS and then incubated in phenol red-free OptiMEMI with or without 50 nM rapamycin for 2 h. 10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time. FIG. 122 illustrates that the NLpoly11S and NLpep101 combination produces the highest induction while maintaining high levels of specific luminescence.

Example 75

Figure 123:
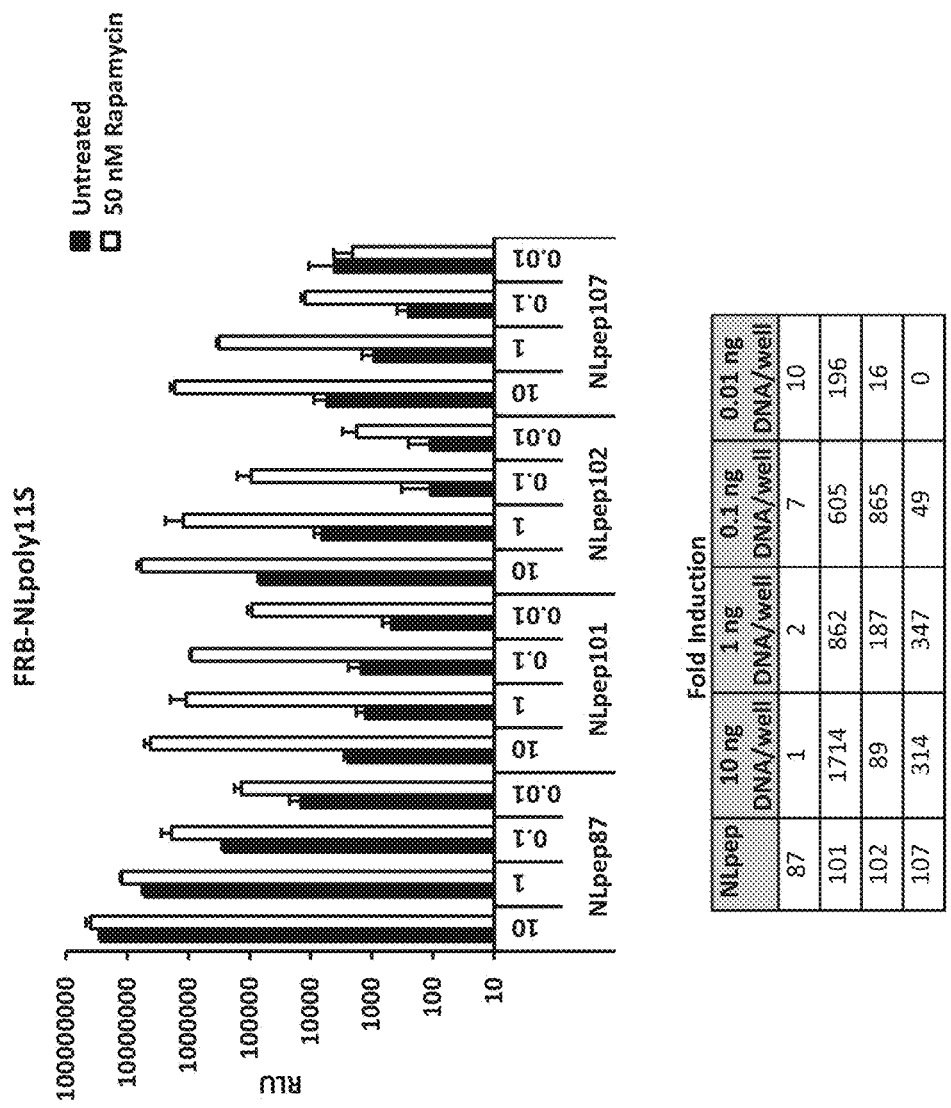
FIG. 123 shows a comparison of luminescence generated by cells transfected with different levels of FRB-NLpoly11S and FKBP-NLpep87/101/102/107 DNA.

Comparison of Luminescence Generated by Cells Transfected with Different Levels of FRB-NLpoly11S and FKBP-NLpep87/101/102/107 DNA HEK293T cells (20,000) were reverse-transfected in opaque 96-well assay plates with a total of 0.01, 0.1, 1, or 10 ng pF4A Ag FRB-NLpoly11S and pF4A Ag FKBP-NLpep87/101/102/107 using FuGENE HD at a DNA-to-FuGENE ratio of 1 to 8. pGEM-3Zf(+) DNA was added to bring total DNA in each transfection to 1 μg. 24 hours-post transfection, cells were washed with PBS and then incubated in phenol red-free OptiMEMI with or without 50 nM rapamycin for 1.5 h. 10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time. FIG. 123 illustrates NLpoly11S with NLpep101 produces the overall lowest luminescence in untreated samples at all tested DNA levels, and the combination maintains relatively high levels of luminescence in rapamycin-treated samples.

Example 76

Figure 124:
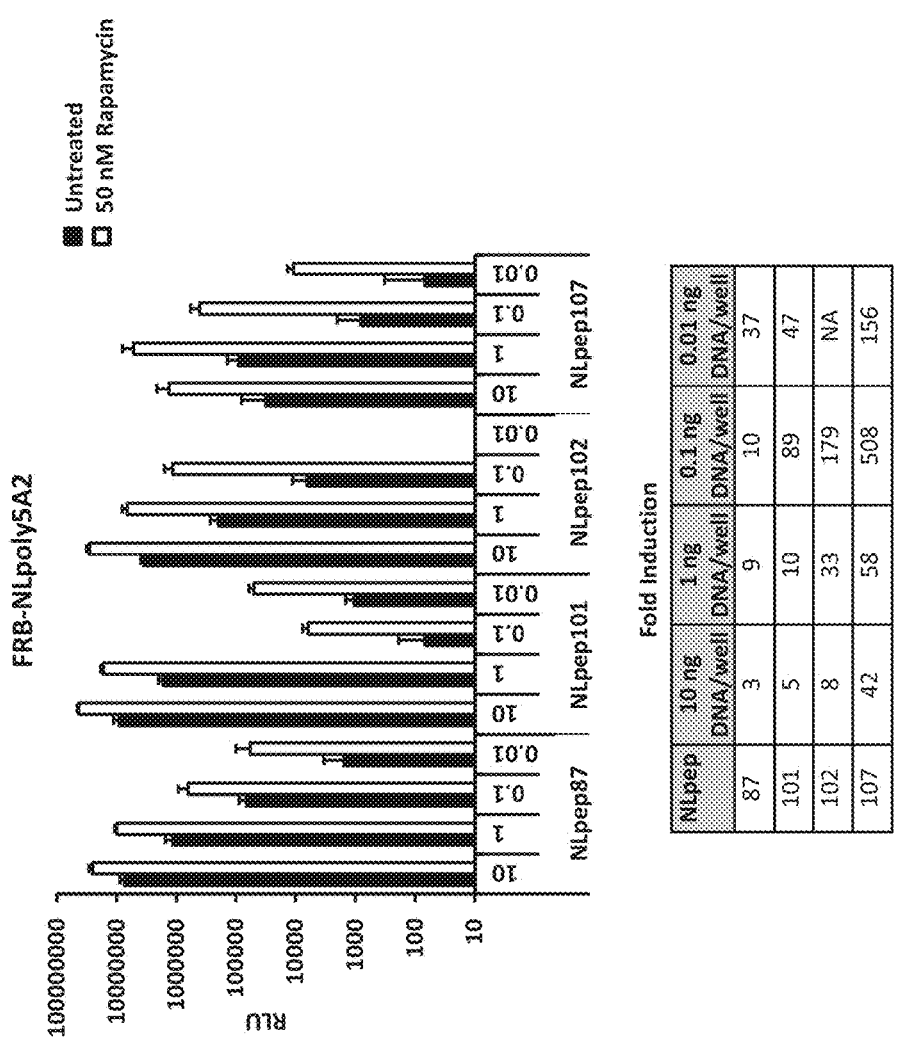
FIG. 124 shows a comparison of luminescence generated by cells transfected with different levels of FRB-NLpoly5A2 and FKBP-NLpep87/101/102/107 DNA.

Comparison of Luminescence Generated by Cells Transfected with Different Levels of FRB-NLpoly5A2 and FKBP-NLpep87/101/102/107 DNA HEK293T cells (20,000) were reverse-transfected in opaque 96-well assay plates with a total of 0.01, 0.1, 1, or 10 ng pF4A Ag FRB-NLpoly5A2 and pF4A Ag FKBP-NLpep87/101/102/107 using FuGENE HD at a DNA-to-FuGENE ratio of 1 to 8. pGEM-3Zf(+) DNA was added to bring total DNA in each transfection to 1 μg. 24 hours-post transfection, cells were washed with PBS and then incubated in phenol red-free OptiMEMI with or without 50 nM rapamycin for 1.5 h. 10 μM furimazine substrate (final concentration on cells) with or without 50 nM rapamycin in OptiMEMI was added directly to each well and incubated at room temperature for 5 min. Luminescence was then measured on a GLOMAX Multi with 0.5 s integration time. FIG. 124 illustrates that NLpoly5A2 generates higher luminescence in untreated samples than NLpoly11S shown in example 75.

Example 77

Rapamycin Dose Response Curve Showing Luminescence of Cells Expressing FRB-NLpoly5P and FKBP-NLpep80/87 DNA HEK293T cells (400,000) were reverse-transfected with a total of 0.001 μg pF4A Ag FRB-NLpoly5P and 0.001 μg pF4A Ag FKBP-NLpep80/NLpep87 using FuGENE HD at a DNA-to-FuGENE ratio of 1 to 8. pGEM-3Zf(+) DNA was added to bring total DNA in each transfection to 1 μg.

Figure 125:
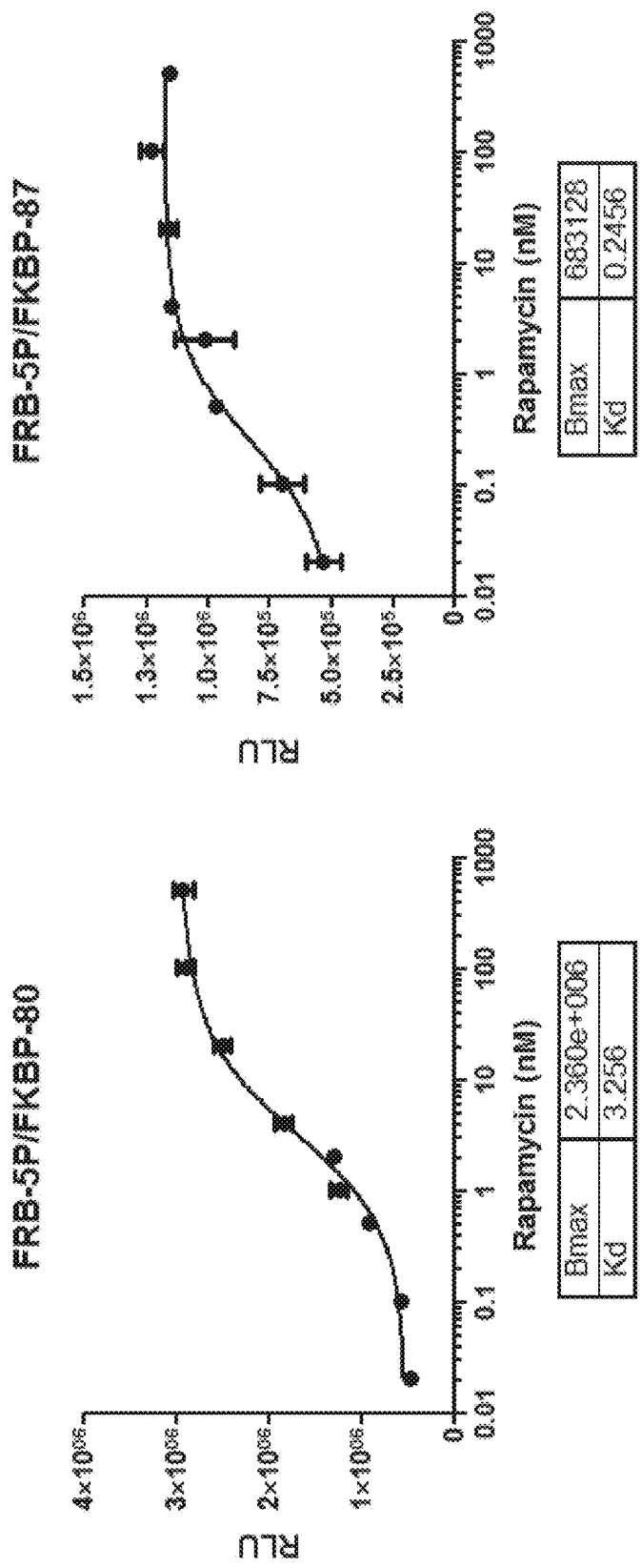
FIG. 125 shows a rapamycin dose response curve showing luminescence of cells expressing FRB-NLpoly5P and FKBP-NLpep80/87 DNA.

24-hours post-transfection, 10,000 cells were re-plated in opaque 96-well assay plates and incubated an additional 24 hours. Cells were washed with PBS and then incubated in phenol red-free OptiMEMI with 0 to 500 nM rapamycin for 2 h. 10 µM furimazine substrate (final concentration on cells) with 0 to 500 nM rapamycin in OptiMEM was added directly to each well and incubated at room temperature for 5 min. Luminescence was then measured on a GLOMAX Multi with 0.5 s integration time. Kd was calculated with GraphPad Prism version 5.00 for Windows. FIG. 125 illustrates a rapamycin-specific increase in luminescence.

Example 78

Figure 126:
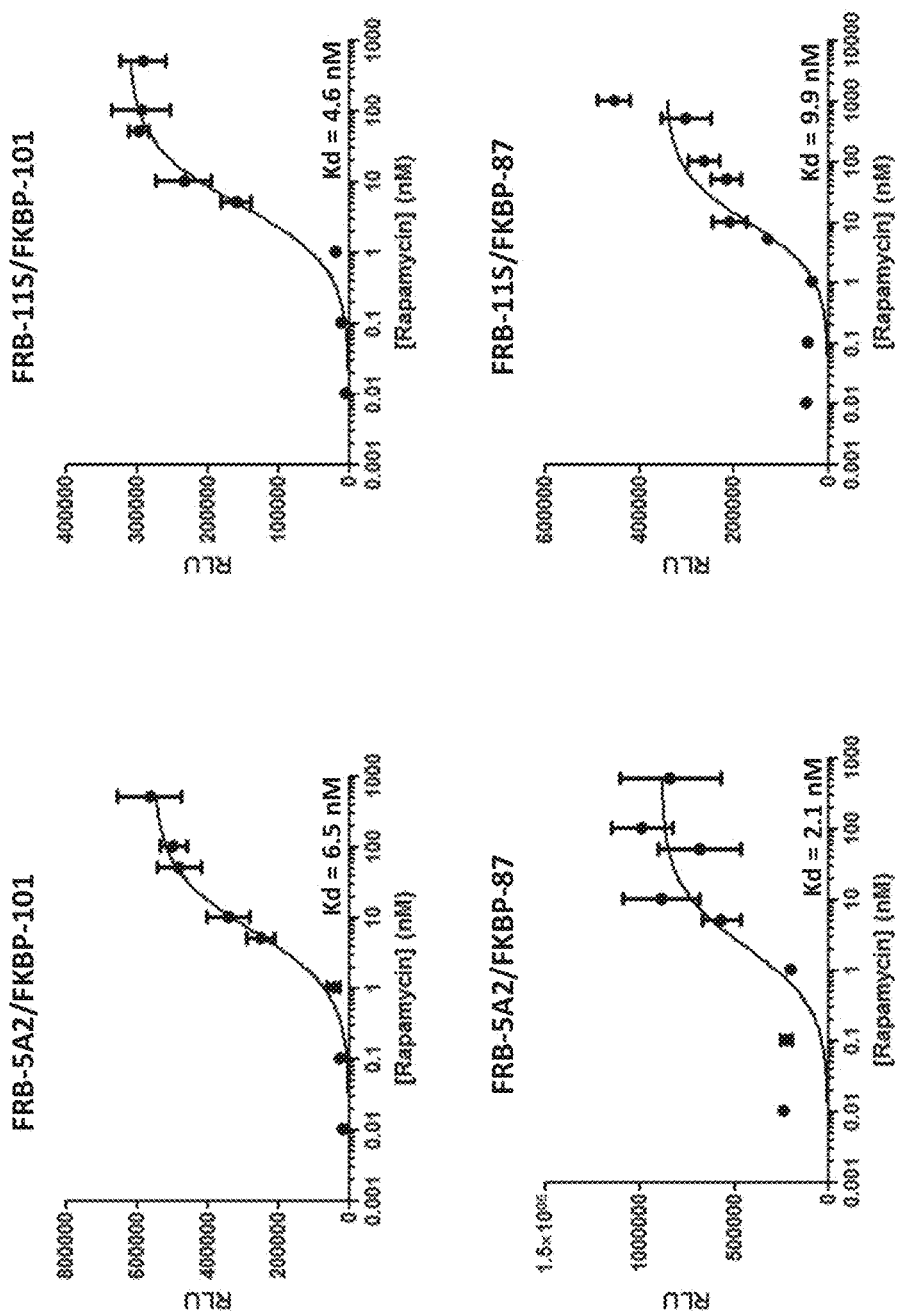
FIG. 126 shows a rapamycin dose response curve showing luminescence of cells expressing FRB-NLpoly5A2 or FRB-NLpoly11S and FKBP-NLpep87/101 DNA.

Rapamycin Dose Response Curve Showing Luminescence of Cells Expressing FRB-NLpoly5A2 and FKBP-NLpep87/101 DNA HEK293T cells (20,000) were reverse-transfected in opaque 96-well assay plates with a total of 0.1 ng pF4A Ag FRB-NLpoly5A2/11S and pF4A Ag FKBP-NLpep87/101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then incubated in phenol red-free OptiMEMI with 0 to 1 µM rapamycin for 1.5 h. 10 µM furimazine substrate (final concentration on cells) with 0 to 1 µM rapamycin in OptiMEMI was added directly to each well and incubated at room temperature for 5 min. Luminescence was then measured on a GLOMAX Multi with 0.5 s integration time. FIG. 126 illustrates a sigmoidal dose response to rapamycin with NLpoly5A2/NLpep101 and NLpoly11S/NLpep10 combinations. While combinations with NLpep87 show an increase in luminescence with rapamycin, the collected data points deviate more from the sigmoidal curve.

Example 79

Figure 127:
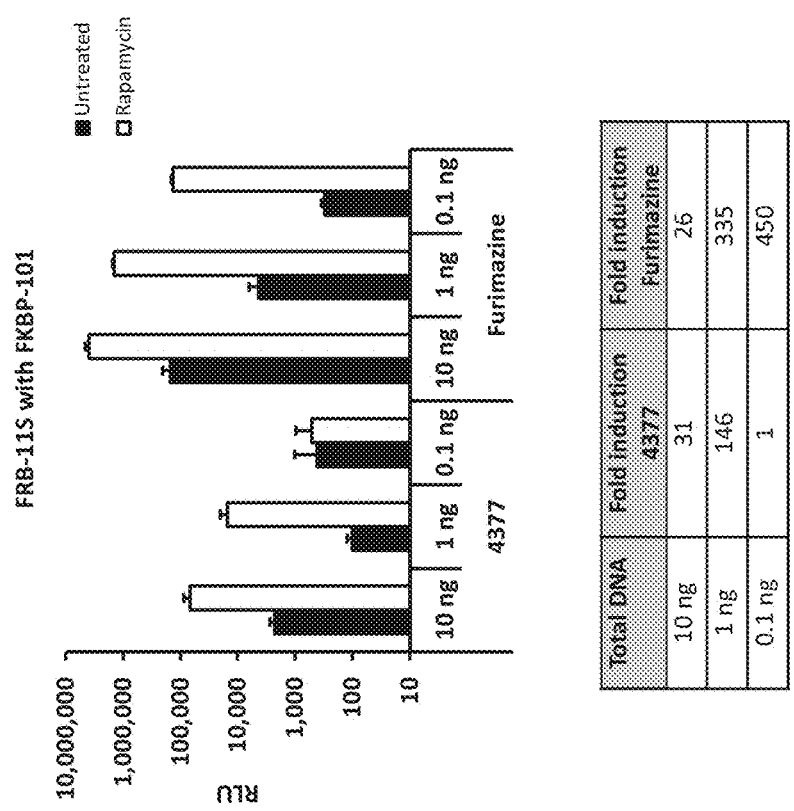
FIG. 127 shows a comparison of luminescence generated by cells expressing FRB-11S and FKBP-101 and treated with substrate PBI-4377 or furimazine.

Comparison of Luminescence Generated by Cells Expressing FRB-11S and FKBP-101 and Treated with Substrate PBI-4377 or Furimazine HEK293T cells (20,000) were reverse-transfected in opaque 96-well assay plates with a total of 0.1/1/10 ng pF4A Ag FRB-NLpoly11S and pF4A Ag FKBP-NLpep101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then incubated in phenol red-free OptiMEMI with 0 or 50 nM rapamycin for 1.5 h. 10 µM furimazine or PBI-4377 substrate (final concentration on cells) with 0 to 50 nM rapamycin in OptiMEMI was added directly to each well and incubated at room temperature for 5 min. Luminescence was then measured on a GLOMAX Multi with 0.5 s integration time. FIG. 127 illustrates a decrease in luminescence and fold induction with the PBI-4377 substrate compared to the furimazine substrate.

Example 80

Figure 128:
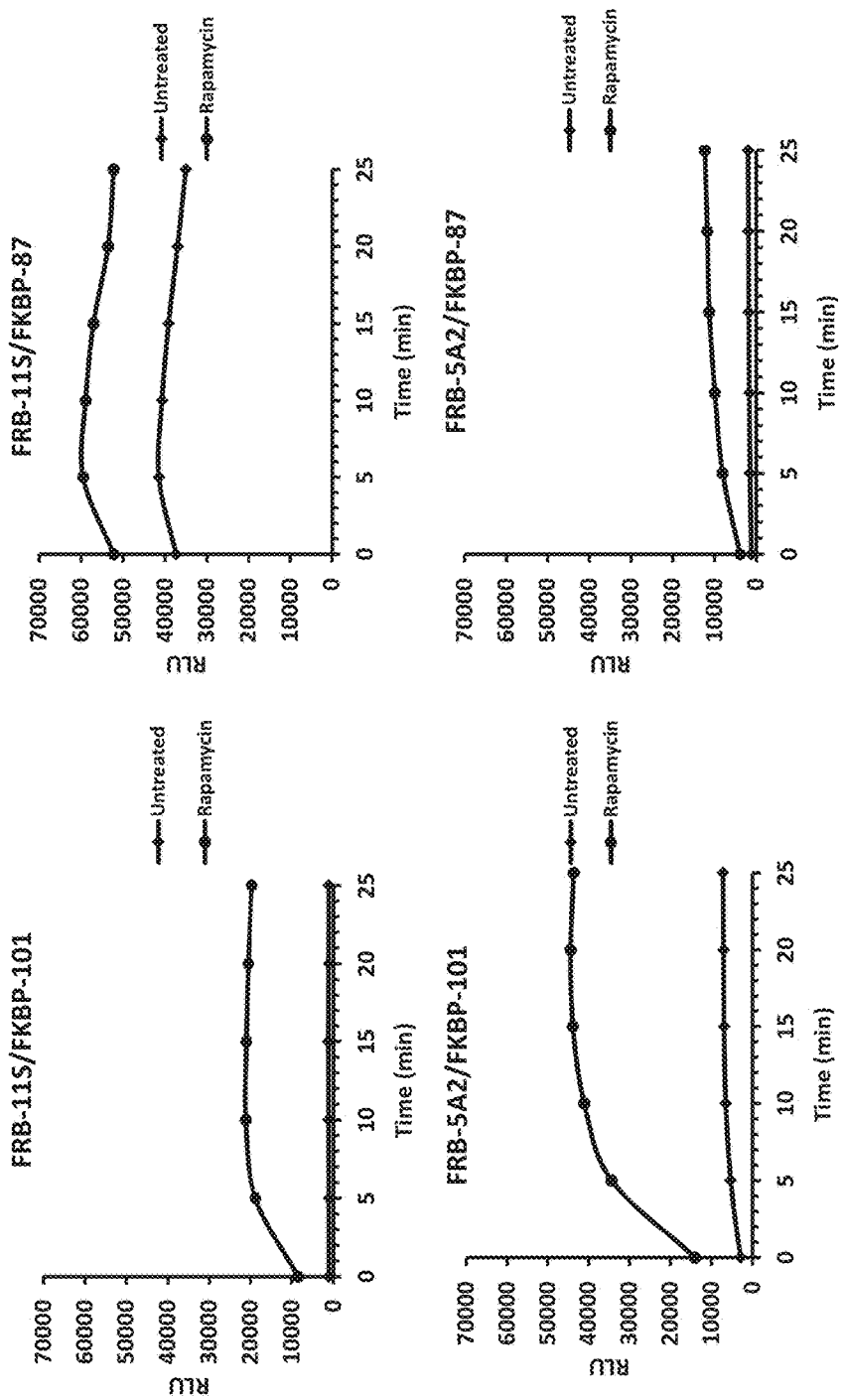
Figure 129:
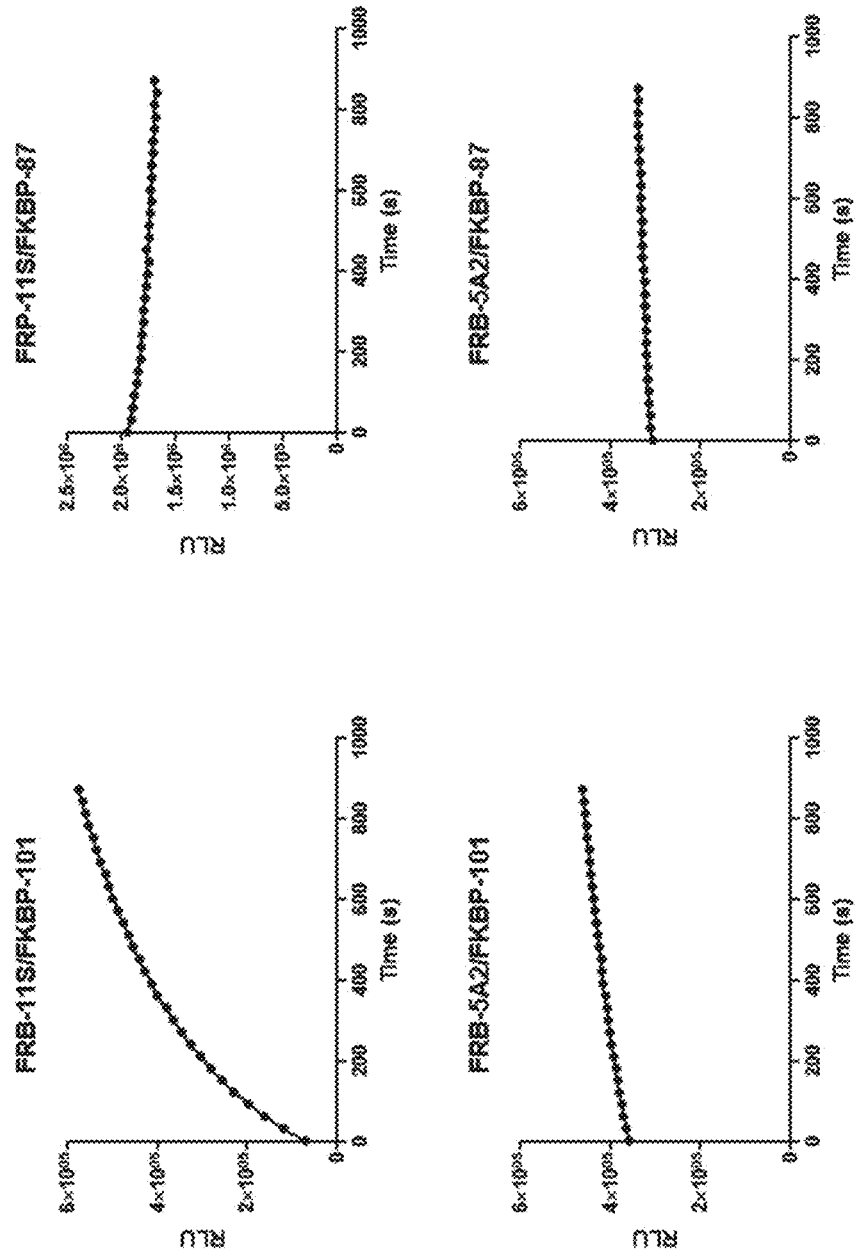

Time Course of Cells Expressing FRB-NLpoly11S/5A2 and FKBP-NLpep87/101 Conducted in the Presence or Absence of Rapamycin HEK293T cells (20,000) were reverse-transfected in opaque 96-well assay plates with a total of 0.1 ng pF4A Ag FRB-NLpoly11S/5A2 and pF4A Ag FKBP-NLpep87/101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 50 nM rapamycin and 10 µM furimazine was added either manually or via instrument injection. Luminescence was immediately measured on a GLOMAX Multi with 0.5 s integration time. FIGS. 128 and 129 illustrate that, of all combinations tested, NLpoly11S with NLpep101 has the lowest luminescence at time 0, hits a luminescent plateau faster and has the largest dynamic range.

Example 81

Luminescence Generated by FRB-NLpoly11S and FKBP-NLpep01 as Measured on Two Different Instruments HEK293T cells (20,000) were reverse-transfected in opaque 96-well assay plates with a total of 0.1 ng pF4A Ag FRB-NLpoly11S and pF4A Ag FKBP-NLpep 101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 50 nM rapamycin was added for 20 min. 10 µM furimazine (final concentration on cells) in OptiMEMI with 0 or 50 nM rapamycin was added and incubated for an additional 5 min. Luminescence was immediately measured on a GLOMAX Multi with 0.5 s integration time and on the Varioskan Flash with 450 nM band pass filter. FIG. 130 illustrates that the rapamycin-specific induction of FRB-NLpoly11S and FKBP-NLpep101 can be measured on different instruments.

Example 82

Images Showing Luminescence of Cells Expressing FRB-NLpoly11S and FKBP-NLpep101 at Various Times after Treatment with Rapamycin HeLa cells (500.000) were reverse transfected with 1 µg pF4 Ag FRB-NLpoly11S and 1 µg pF4 Ag FKBP-NLpep 101 using FuGENE HD at a DNA to FuGENE ratio of 1 to 4. Cells were transfected in 35 mm glass bottom culture dishes (MatTek #p35gc-1.5-14-C). 24 hours post-transfection, cells were washed with PBS and then incubate with 10 µM furimazine in OptiMEM for 5 min. 50 nM rapamycin in OptiMEMI was added to cells and luminescent images were acquired with LV200 at 10 s intervals for a total of 20 min. Instrument was at 37° C., objective was 60×, gain was 200 and exposure was 600 ms. FIG. 131 illustrates that imaging can detect an increase in cellular luminescence in cells expressing FRB-NLpoly11S and FKBP-NLpep01 following rapamycin treatment.

Example 83

Quantitation of the Signal Generated by Individual Cells Expressing FRB-NLpoly11S and FKBP-NLpep101 at Various Times after Treatment with Rapamycin HeLa cells (500,000) were reverse transfected with 1 µg pF4 Ag FRB-NLpoly11S and 1 µg pF4 Ag FKBP-NLpep101 using FuGENE HD at a DNA to FuGENE ratio of 1 to 4.

Cells were transfected in 35 mm glass bottom culture dishes (MatTek #p35gc-1.5-14-C). 24 hours post-transfection, cells were washed with PBS and then incubate with 10 µM furimazine in OptiMEM for 5 min. 50 nM rapamycin in OptiMEMI was added to cells, and luminescent images were acquired with LV200 at 10 s intervals for a total of 20 min. Instrument was at 37° C., objective was 60×, gain was 200, and exposure was 600 ms. The signal intensity of every cell in the field of view was analyzed with Image J software over the entire time period. FIG. 132 illustrates that signal generated by individual cells can be measured and that the increase in signal by each cell parallels the increase observed in the 96-well plate assay shown in FIGS. 128 and 129.

Example 84

Comparison of Luminescence in Different Cell Lines Expressing FRB-NLpoly11S and FKBP-NLpep101

HEK293T, HeLa, or U2-OS cells (20,000) were reverse-transfected in opaque 96-well assay plates with a total of 0.1 ng pF4A Ag FRB-NLpoly11S and pF4A Ag FKBP-NLpep 101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 50 nM rapamycin was added for 20 min. 10 µM furimazine (final concentration on cells) in OptiMEM with 0 or 50 nM rapamycin was added and incubated for an additional 5 min. Luminescence was immediately measured on a GLOMAX Multi with 0.5 s integration time. FIG. 133 illustrates similar levels of luminescence generated in the absence and presence of rapamycin in three different cells lines transfected with FRB-NLpoly11S and FKBP-NLpep101.

Example 85

Comparison of Luminescence Generated by Cells Expressing FRB-NLpoly11S and FKBP-NLpep101 after Treatment with the Rapamycin Competitive Inhibitor FK506

HEK293T cells (20.000) were reverse-transfected in opaque 96-well assay plates with a total of 0.1 ng pF4A Ag FRB-NLpoly11S and pF4A Ag FKBP-NLpep 101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 20 nM rapamycin was added for 20 min. FK506 inhibitor in OptiMEM was added to cell at final concentration of 5 µM and incubated for 3 or 5 hours. Furimazine in OptiMEM was added to cells for a final concentration of 10 µM on cells. Luminescence was immediately measured on a GLOMAX Multi with 0.5 s integration time. FIG. 134 illustrates a decrease in rapamycin-induced luminescence after treatment with the competitive inhibitor FK506.

Example 86

Luminescence Generated by Cells Expressing FRB-NLpoly11S and FKBP-NLpep101I after Treatment with the Rapamycin Competitive Inhibitor FK506

HEK293T cells (20,000) were reverse-transfected in opaque 96-well assay plates with a total of 0.1 ng pF4A Ag FRB-NLpoly11S and pF4A Ag FKBP-NLpep101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 20 nM rapamycin was added for 2.5 hours. FK506 inhibitor in OptiMEM was added to cell via injector at final concentration of 0, 1 or 10 µM in OptiMEM with 10 µM. Luminescence was measured every 10 min for 4 hours on a GLOMAX Multi set to 37° C. with 0.5 s integration time. FIG. 135 illustrates that by 200 s, FK506 inhibitor can reduce luminescence close to levels of untreated cells.

Example 87

Luminescence Generated by Cells Transfected with Different Combinations of V2R-NLpoly5A2 or V2R-NLpoly11S with NLpep87/101-ARRB2 in the Presence or Absence of the V2R Agonist AVP HEK293T cells (20,000) were reverse-transfected in opaque 96-well assay plates with a total of 0.1, 1, or 10 ng pF4A Ag V2R-NLpoly11S and pF4A Ag ARRB2-NLpep87/101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 1 µM AVP and 10 µM furimazine was added for 25 min. Luminescence was then measured on a GLOMAX Multi with 0.5 s integration time.

FIG. 136 illustrates that V2R-NLpoly11S with NLpep101 generates the greatest AVP-specific increase in luminescence. Combinations with NLpep87 show no significant response to AVP.

Example 88

Time Course Showing Luminescence Generated by Cells Transfected with V2R-NLpoly5A2 or V2R-NLpoly11S and NLpep87/101-ARRB2 after Treatment with AVP HEK293T cells (20,000) were reverse-transfected in opaque 96-well assay plates with a total of 0.1 or 1 ng pF4A Ag V2R-NLpoly11S or 1 ng pF4A Ag V2R-NLpoly5A2 and pF4A Ag ARRB2-NLpep87/101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 1 µM AVP and 10 µM furimazine was added either manually (FIG. 137) or via instrument injection (FIG. 138). Luminescence was then measured on a GLOMAX Multi every 5 min for 25 min with 0.5 s integration time at room temperature (FIGS. 137 and 138) or 37° C. (FIG. 139). FIGS. 137 and 138 illustrate a time-dependent increase in AVP-induced luminescence for V2R-NLpoly11S with NLpep101-ARRB2 that begins to peak at 600 s. Combinations with V2R-NLpoly5A2 and NLpep87 do not show a significant increase in luminescence over time. FIG. 139 illustrates that at 37° C. all NLpoly11S and NLpep101 combinations tested show a time-dependent increase in AVP-induced luminescence that levels out around 200 s.

Example 89

Comparison of Luminescence in Different Cell Lines Expressing V2R-NLpoly11S and NLpep101-ARRB2

HEK293T, HeLa, or U2-OS cells (20,000) were reverse-transfected in opaque 96-well assay plates with a total of 1 ng pF4A Ag V2R-NLpoly11S and pF4A Ag ARRB2-NL-pep87/101 using FuGENE HD at a DNA-to-FuGENE ratio of 1 to 8. pGEM-3Zf(+) DNA was added to bring total DNA in each transfection to 1 µg. 24 hours-post transfection, cells were washed with PBS and then phenol red-free OptiMEMI with 0 or 1 µM AVP was added for 20 min. Furimazine in OptiMEM was then added to a final concentration of 10 M on cells, and luminescence was measured on a GLOMAX Multi with 0.5 s integration time.

FIG. 140 illustrates similar luminescence levels in three different cell lines expressing V2R-NLpoly11S and NLpep 101-ARRB2 in the presence and absence of AVP.

Example 90

Luminescence of Cells Expressing V2R-NLpoly11S and NLpep101-ARRB2 at Various Times after Treatment with AVP HeLa cells (500,000) were reverse transfected with 1 µg pF4 Ag V2R-NLpoly11S and 1 µg pF4 Ag ARRB2-NLpep 101 using FuGENE HD at a DNA to FuGENE ratio of 1 to 4. Cells were transfected in 35 mm glass bottom culture dishes (MatTek #p35gc-1.5-14-C). 24 hours post-transfection, cells were washed with PBS and then incubate with 10 µM furimazine in OptiMEM for 5 min. 1 µM AVP in OptiMEMI was added to cells, and luminescent images were acquired with LV200 at 15 s intervals for a total of 30 min. Instrument was at 37° C., objective was 60× or 150×, gain was 600, and exposure was Is or 2 s. FIGS. 141 and 142 illustrate that imaging can detect the increase in luminescence and formation of punctuate in individual cells after treatment with AVP.

Example 91

Dissociation Constants for NLpeps

Figure 80:
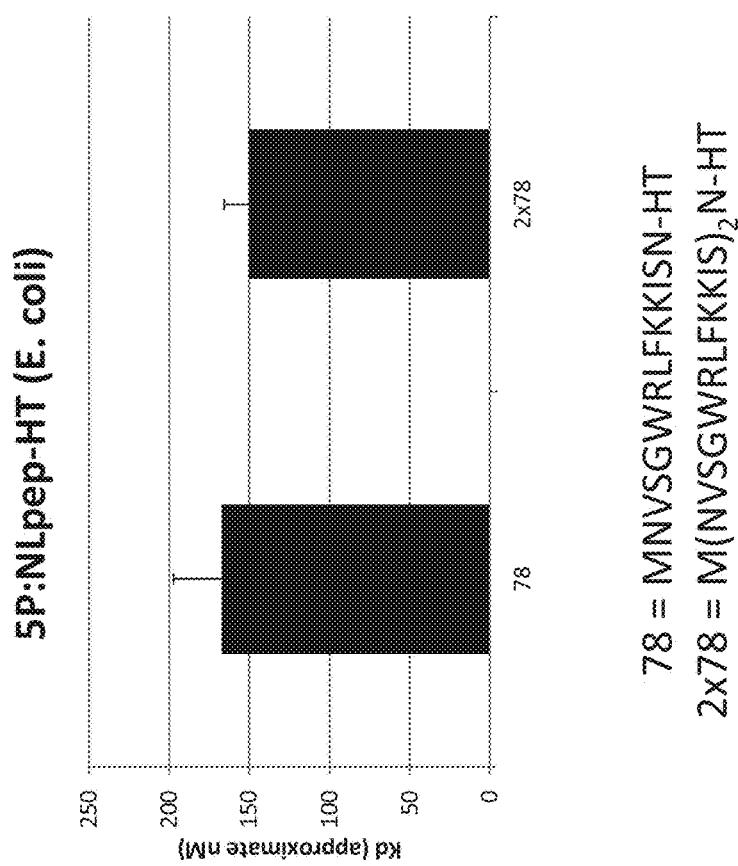
FIG. 80 compares the dissociation constants for NLpeps consisting of either 1 (SEQ ID NO: 156) or 2 (SEQ ID NO: 2580) repeat units of NLpep78.

NLpoly 5P E. coli clarified lysate (prepared as described previously) was diluted 1:1,000 into PBS+0.1%. PRIONEX4× concentrations of NLpep78-HT (E. coli clarified lysate prepared as described previously) were made in PBS+0.1% PRIONEX. 20 uL NLpoly 5P and 20 uL NLpep78 were mixed and shaken for 10 min at RT. 40 uL NANOGLO/Fz was added and shaken for 10 min at RT. Luminescence was measured on GLOMAX luminometer with 0.5 s integration. Kd was determined using Graphpad Prism, One site-specific binding, best-fit values. FIG. 80 compares the dissociation constants for an NLpep consisting of either 1 or 2 repeat units of NLpep78.

Example 92

Affinity Between NLpoly 5A2 and NLpep86

Figure 81:
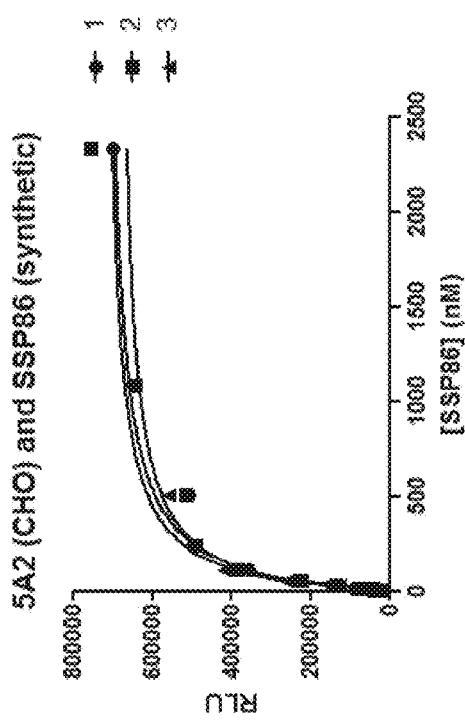
FIG. 81 shows the affinity between NLpoly 5A2 and NLpep86.

NLpoly 5A2 lysate (prepared as described previously after transfecting CHO cells) was diluted 1:10 into PBS+0.1% PRIONEX. 4× concentrations of NLpep86 (synthetic NLpep) were made in PBS+0.1% PRIONEX 20 uL NLpoly and 20 uL NLpep were mixed and shaken for 10 min at RT. 40 uL NANOGLO/Fz was added and shaken for 10 min at RT. Luminescence was measured on GLOMAX luminometer with 0.5 s integration. Kd was determined using Graphpad Prism, One site-specific binding, best-fit values. FIG. 81 illustrates the affinity between NLpoly 5A2 and NLpep86.

Example 93

Luminescence of NLpoly Variants

Figure 82:
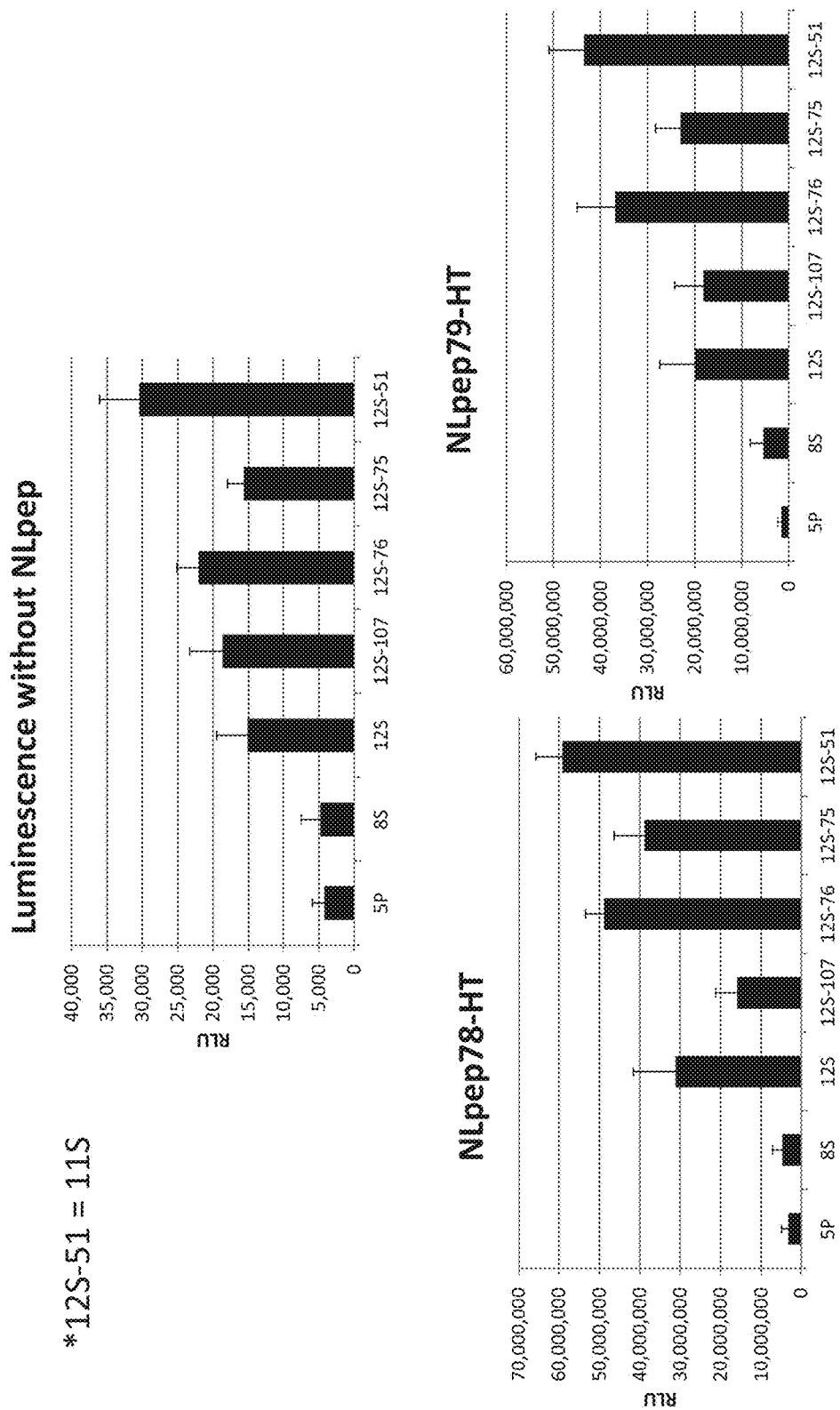
FIG. 82 shows graphs of the luminescence from NLpoly variants without NLpep, with NLpep78, and NLpep79.
Figure 83:
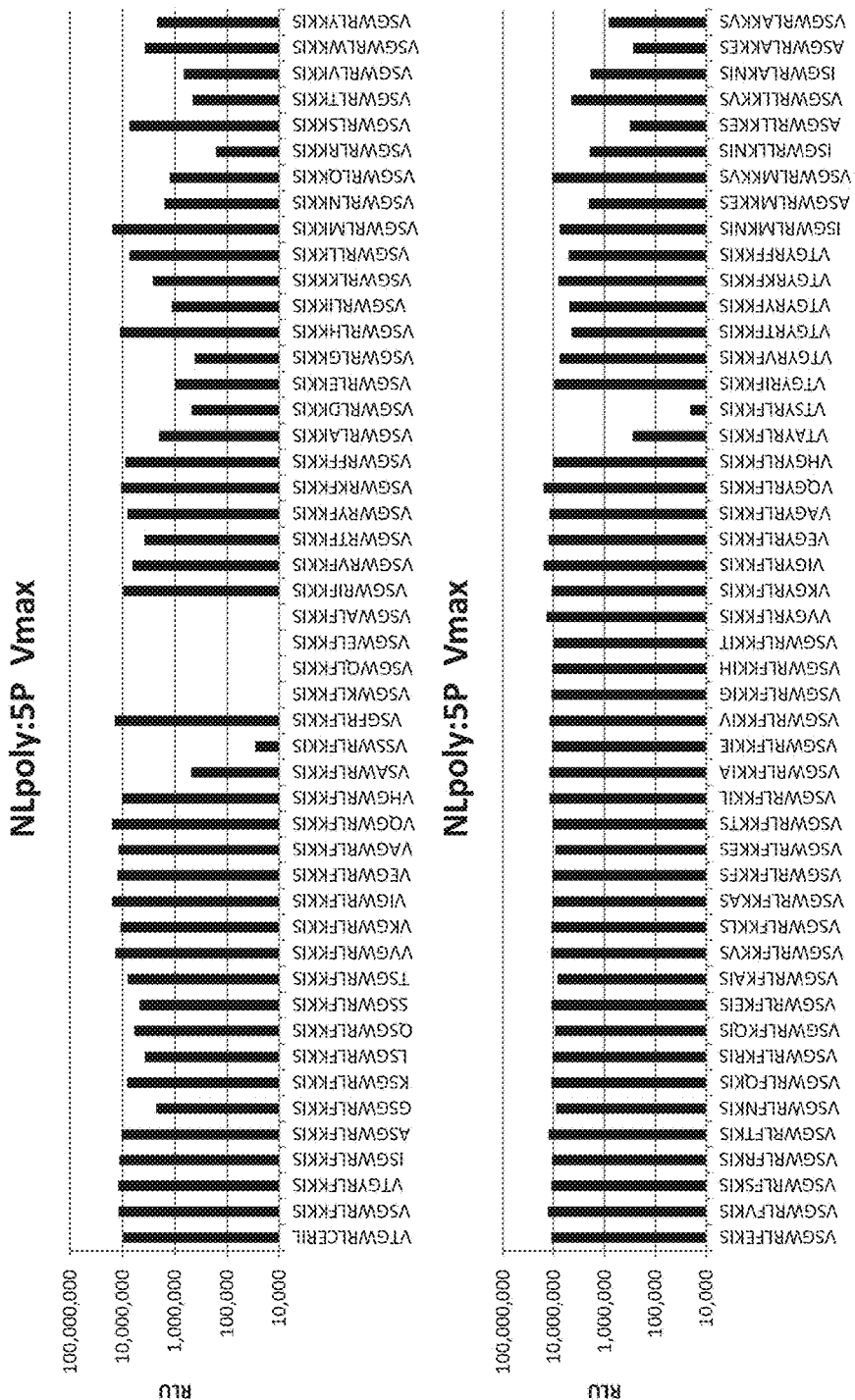
Figure 84:
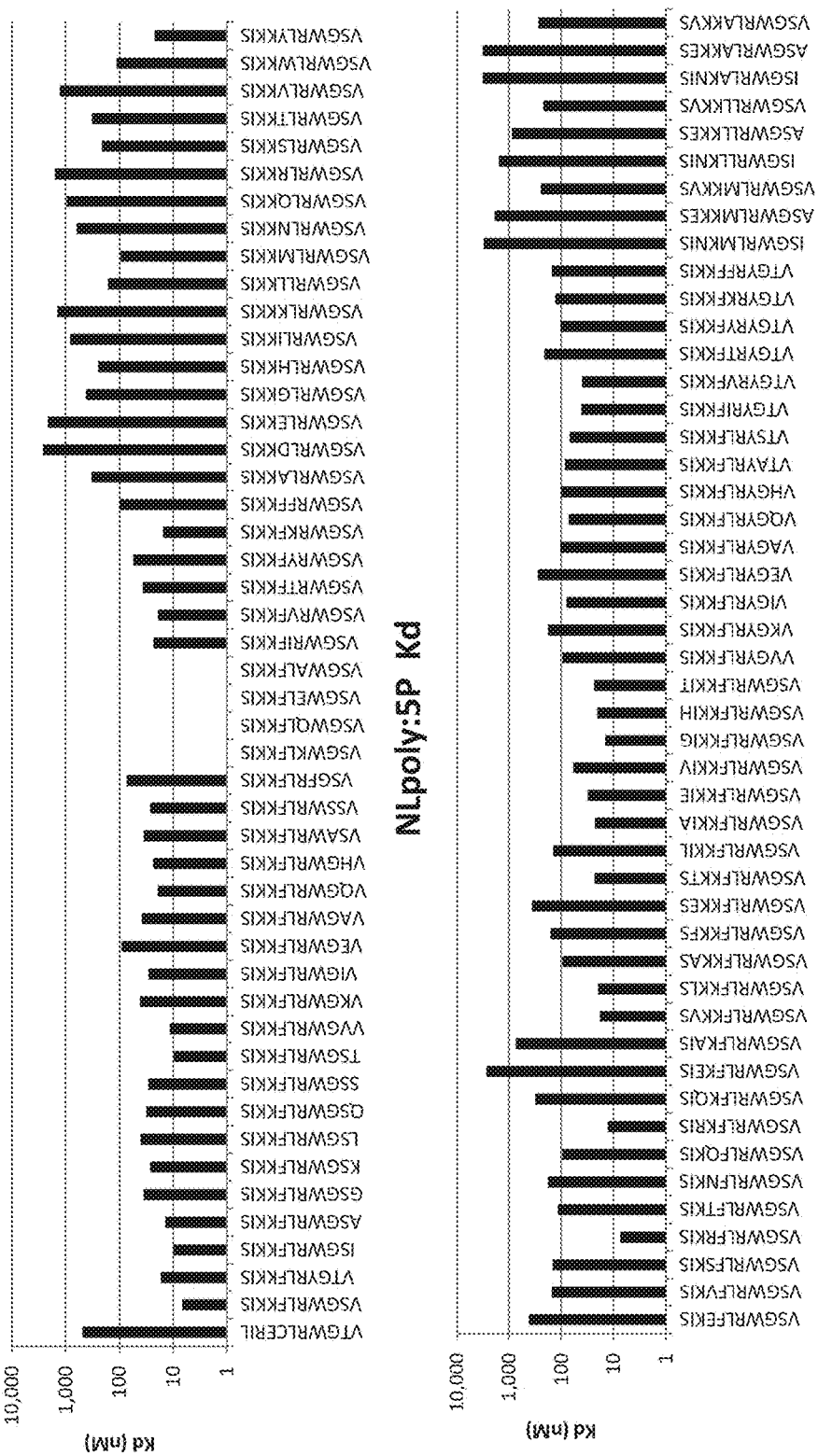
Figure 85:
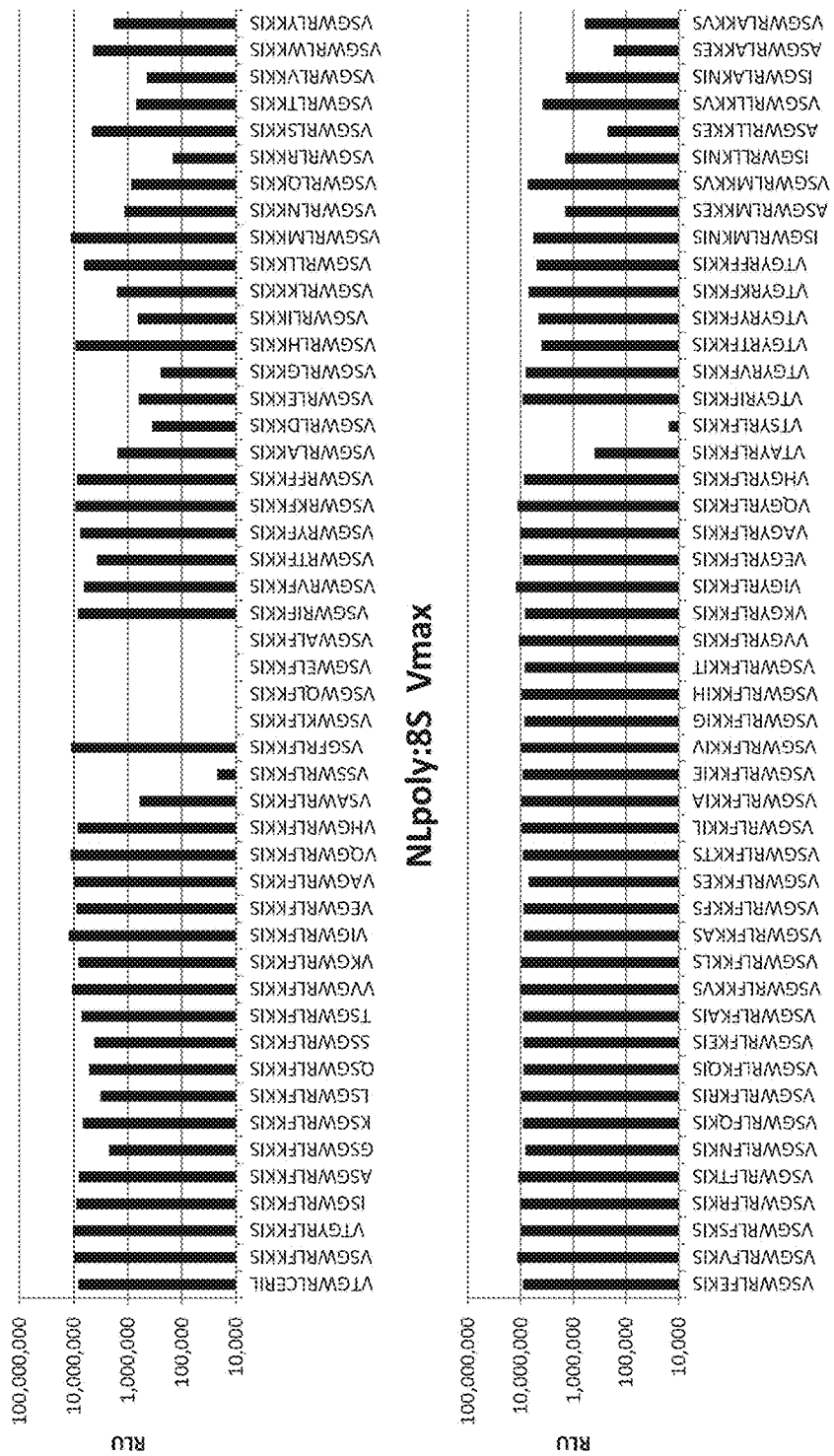
Figure 86:
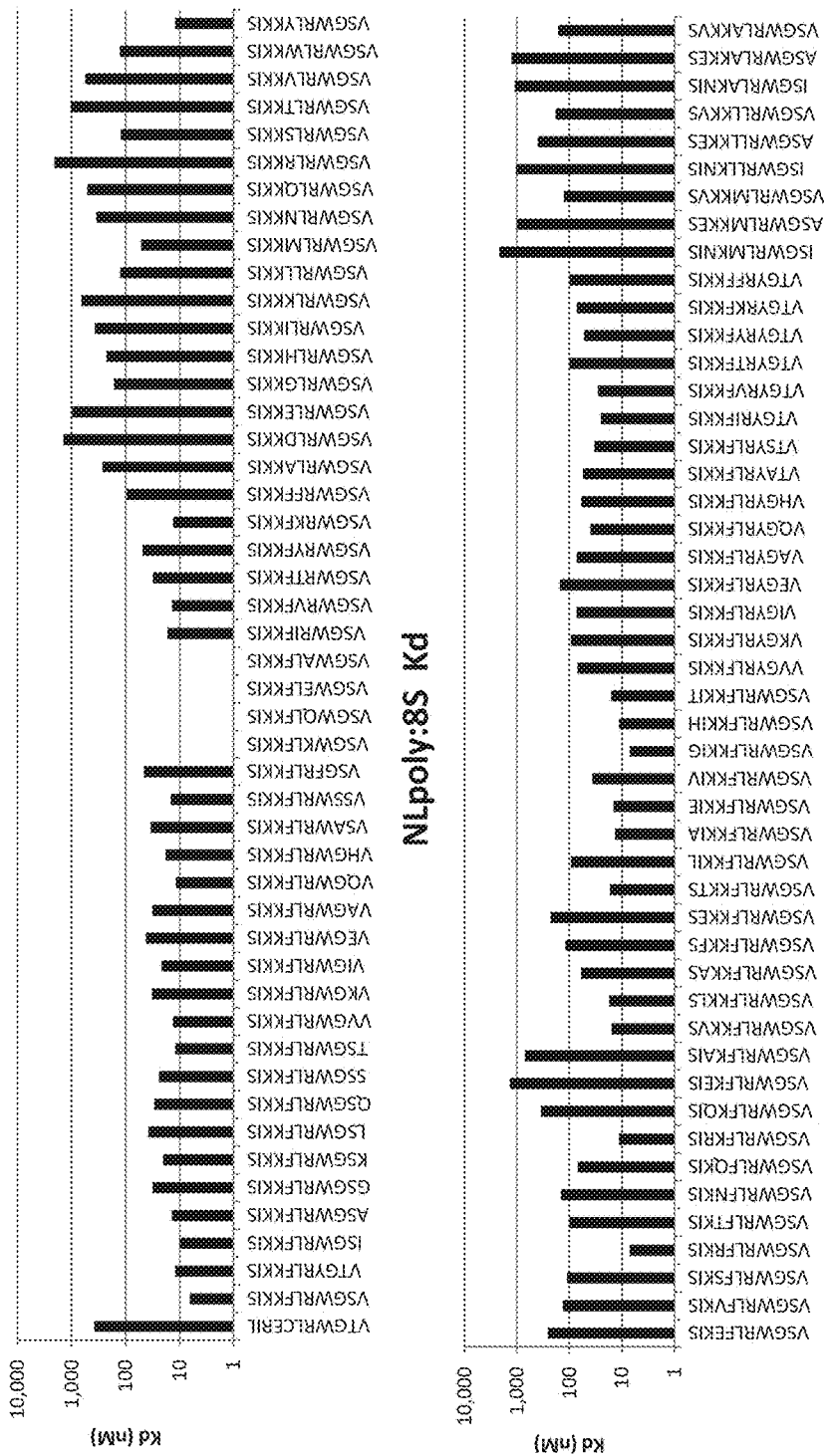
Figure 87:
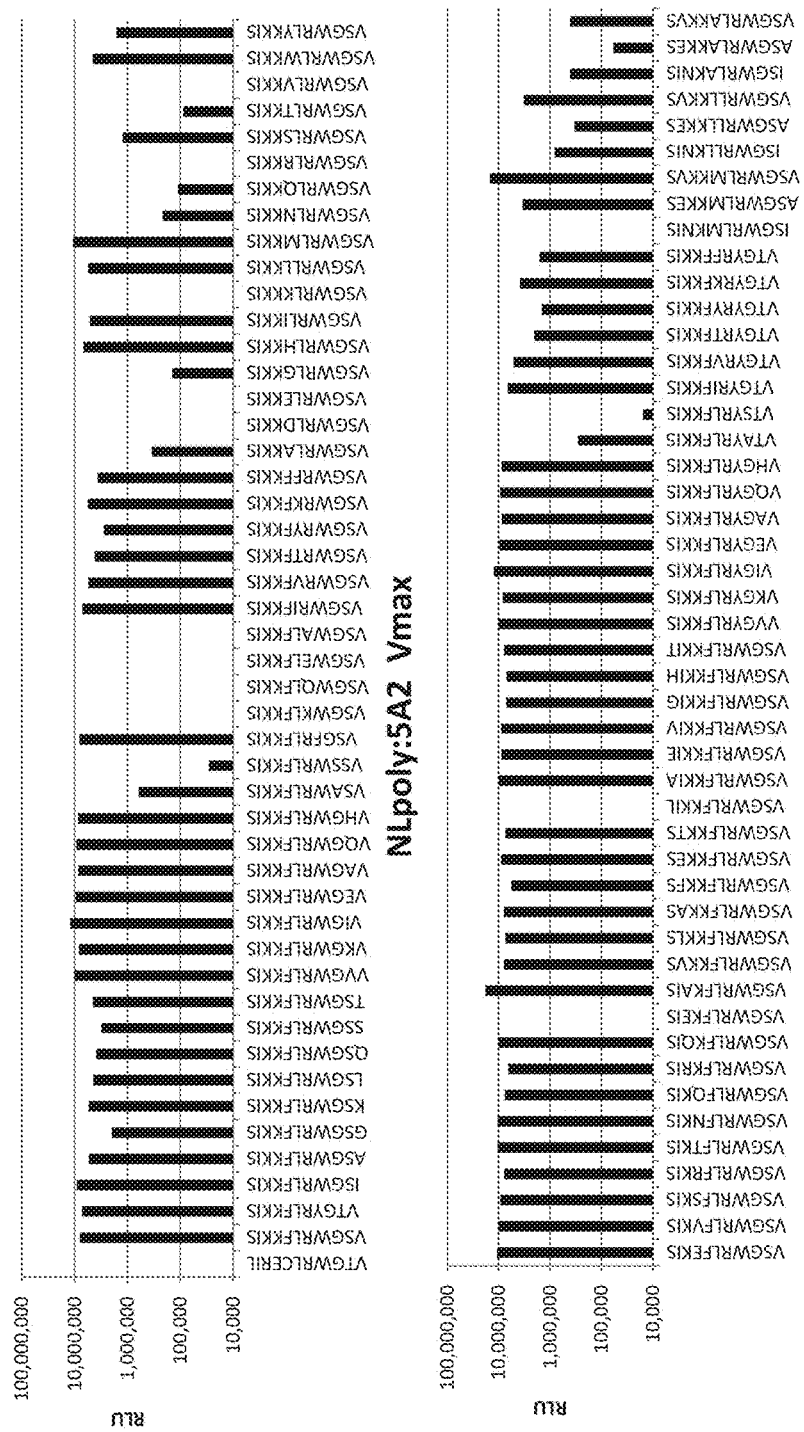
Figure 89:
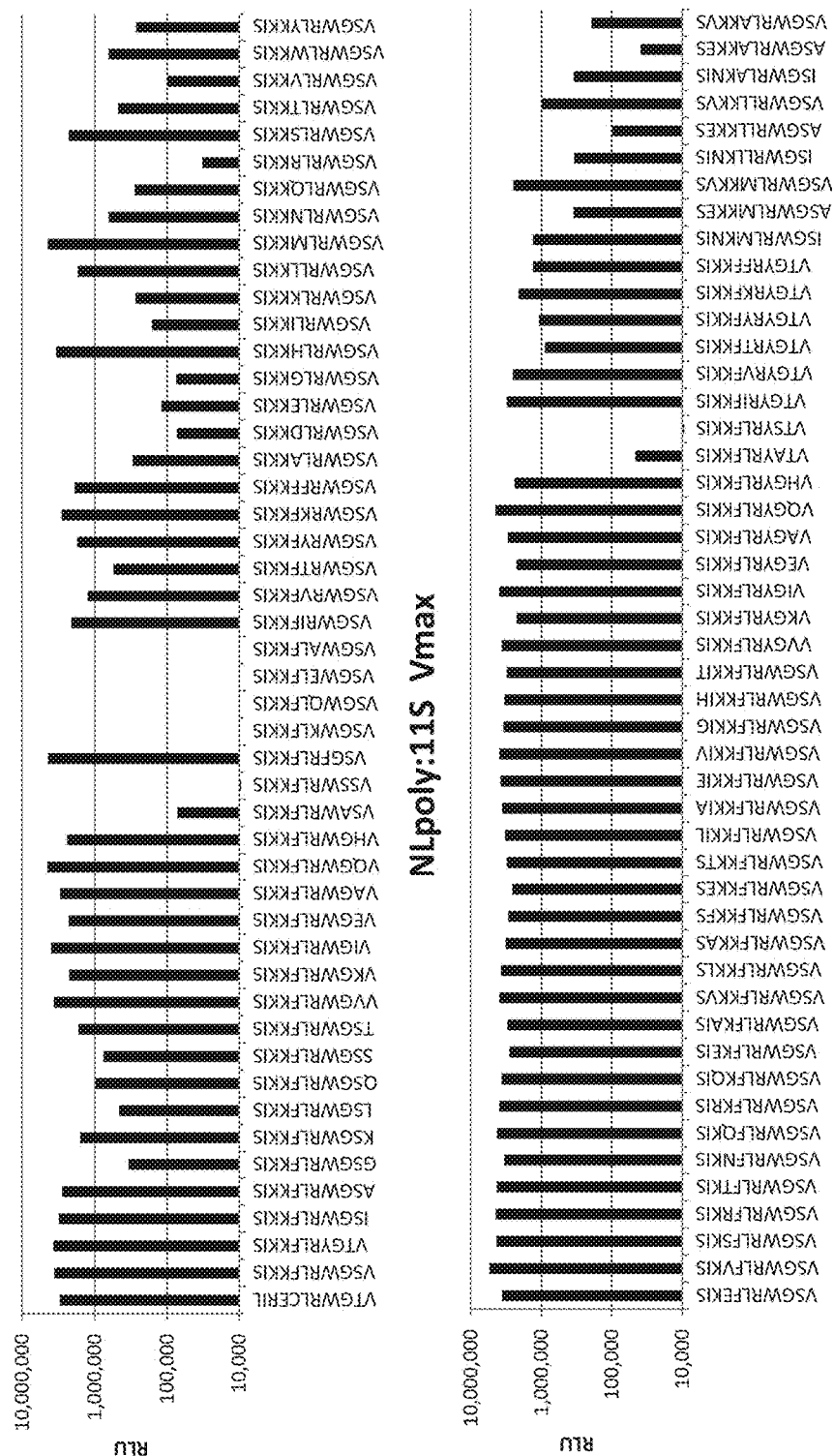
Figure 90:
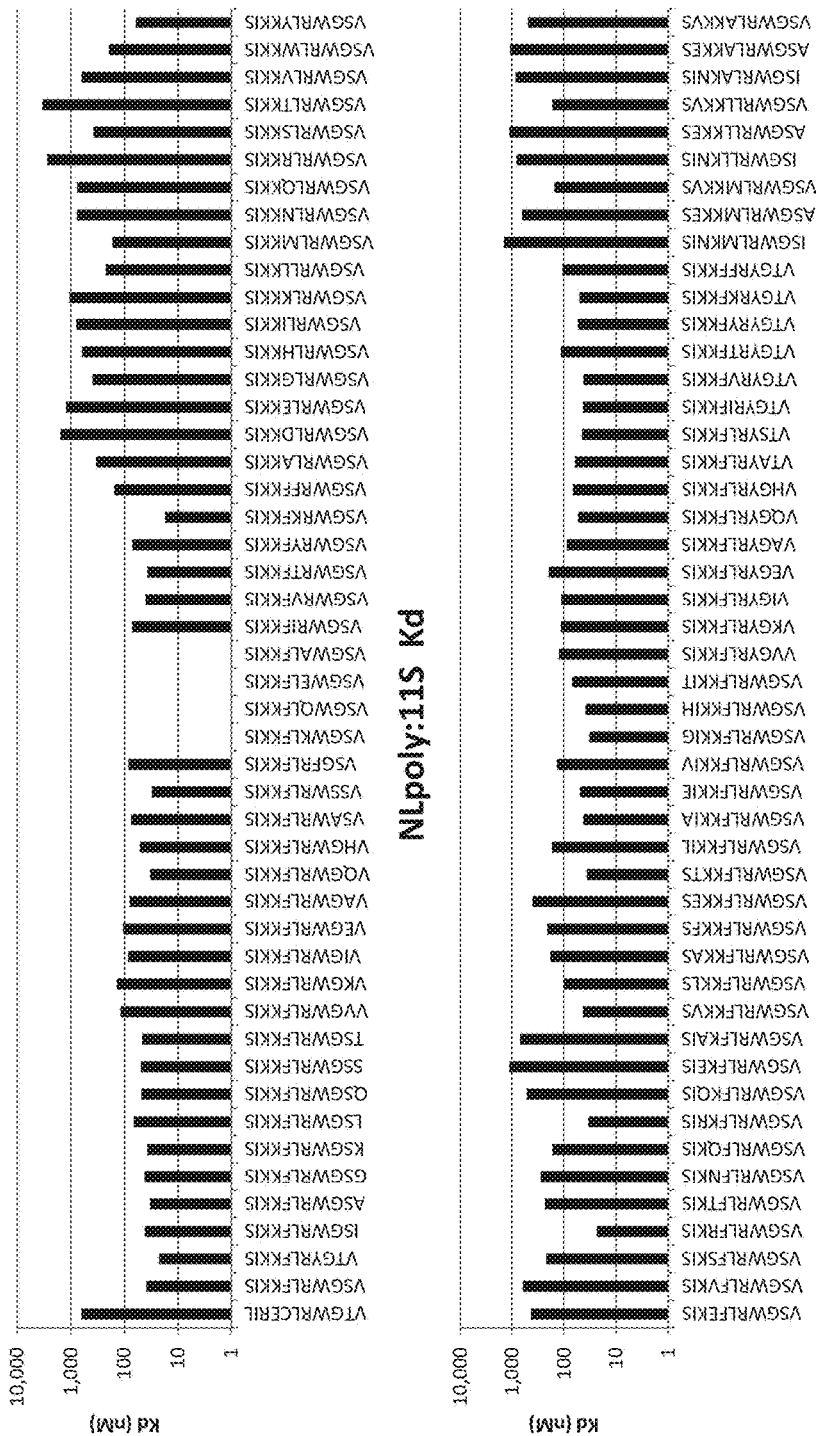

A single colony of various NLpolys were inoculated individually into 200 uL minimal media and grown for 20 hrs at 37° C. on shaker. 10 uL of overnight culture was diluted into 190 uL fresh minimal media and grown for 20 hrs at 37° C. on shaker. 10 uL of this overnight culture was diluted into 190 uL auto-induction media (previously described) and grow for 18 hrs at 25° C. on shaker. 10 uL of the expression culture was mixed with 40 uL of assay lysis buffer (previously described) without NLpep or with NLpep78-HT (1:3,860 dilution) or NLpep79-HT (1:10,000 dilution). The mixtures were shaken for 10 min at RT, 50 uL NANOGLO+Fz added and shaken again for 10 min at RT. Luminescence was measured on a GLOMAX luminometer with 0.5 sec integration. FIG. 82 demonstrates the luminescence from NLpoly variants without an NLpep or with NLpep78 or NLpep79. The results show that the NLpoly variant 11 S (12S-51) has improved luminescence over the other variants.

Example 94

Dissociation Constants and Vmax Values for NLpolys with 96 Variants of NLpeps

NLpeps were synthesized in array format by New England Peptide (peptides blocked at N-terminus by acetylation and at C-terminus by amidation: peptides in arrays were synthesized at ~1 mg scale) (Table 6). Each peptide was lyophilized in 3 separate plates. Each well from 1 of the 3 plates of peptides was dissolved in 100 uL nanopure water, and the A260 measured and used to calculate the concentration using the extinction coefficient of each peptide. The concentration was then adjusted based on the purity of the peptide, and nanopure water was added to give a final concentration of 750 uM.

Peptides were diluted to 12.66 uM (4×) in PBS+0.1% PRIONEX and then diluted serially 7 times (8 concentrations total) in 0.5 log steps (3.162 fold dilution). NLpolys 5P, 8S, 5A2 or 11S were diluted into PBS+0.1% PRIONEX as follows: 5P 1:2,000; 8S 1:10,000; 11S 1:150,000, 5A2 1:1,000, 25 uL each NLpep+25 uL each NLpoly were mixed and incubated for 30 min at RT. 50 uL NANOGLO+100 uM Fz was added and incubated for 30 min at RT. Luminescence was measure on a GLOMAX Multi+ with 0.5 sec integration. Kd/Vmax were determined using Graphpad Prism. One site-specific binding, best-fit values. FIGS. 83-90 illustrate the dissociation constant and Vmax values from NLpolys with the 96 variant NLpeps. The results indicate specific mutations in the NLpeps that exhibit lower binding affinity without loss in Vmax.

TABLE 6

| Peptide Array 1 | | |
|---|---|---|
| | Sequence | SEQ ID NO. |
| array1.1 | VTGWRLCERIL | 2366 |
| array1.2 | VSGWRLFKKIS | 2367 |
| array1.3 | VTGYRLFKKIS | 2368 |
| array1.4 | ISGWRLFKKIS | 2369 |

TABLE 6-continued

Peptide Array 1

| | Sequence | SEQ ID NO. |
|---|---|---|
| array1.5 | ASGWRLFKKIS | 2370 |
| array1.6 | GSGWRLFKKIS | 2371 |
| array1.7 | KSGWRLFKKIS | 2372 |
| array1.8 | LSGWRLFKKIS | 2373 |
| array1.9 | QSGWRLFKKIS | 2374 |
| array1.10 | SSGWRLFKKIS | 2375 |
| array1.11 | TSGWRLFKKIS | 2376 |
| array1.12 | VVGWRLFKKIS | 2377 |
| array1.13 | VKGWRLFKKIS | 2378 |
| array1.14 | VIGWRLFKKIS | 2379 |
| array1.15 | VEGWRLFKKIS | 2380 |
| array1.16 | VAGWRLFKKIS | 2381 |
| array1.17 | VQGWRLFKKIS | 2382 |
| array1.18 | VHGWRLFKKIS | 2383 |
| array1.19 | VSAWRLFKKIS | 2384 |
| array1.20 | VSSWRLFKKIS | 2385 |
| array1.21 | VSGFRLFKKIS | 2386 |
| array1.22 | VSGWKLFKKIS | 2387 |
| array1.23 | VSGWQLFKKIS | 2388 |
| array1.24 | VSGWELFKKIS | 2389 |
| array1.25 | VSGWALFKKIS | 2390 |
| array1.26 | VSGWRIFKKIS | 2391 |
| array1.27 | VSGWRVFKKIS | 2392 |
| array1.28 | VSGWRTFKKIS | 2393 |
| array1.29 | VSGWRYFKKIS | 2394 |
| array1.30 | VSGWRKFKKIS | 2395 |
| array1.31 | VSGWRFFKKIS | 2396 |
| array1.32 | VSGWRLAKKIS | 2397 |
| array1.33 | VSGWRLDKKIS | 2398 |
| array1.34 | VSGWRLEKKIS | 2399 |
| array1.35 | VSGWRLGKKIS | 2400 |
| array1.36 | VSGWRLHKKIS | 2401 |
| array1.37 | VSGWRLIKKIS | 2402 |
| array1.38 | VSGWRLKKKIS | 2403 |
| array1.39 | VSGWRLLKKIS | 2404 |
| array1.40 | VSGWRLMKKIS | 2405 |
| array1.41 | VSGWRLNKKIS | 2406 |
| array1.42 | VSGWRLQKKIS | 2407 |
| array1.43 | VSGWRLRKKIS | 2408 |
| array1.44 | VSGWRLSKKIS | 2409 |
| array1.45 | VSGWRLTKKIS | 2410 |
| array1.46 | VSGWRLVKKIS | 2411 |
| array1.47 | VSGWRLWKKIS | 2412 |
| array1.48 | VSGWRLYKKIS | 2413 |
| array1.49 | VSGWRLFEKIS | 2414 |
| array1.50 | VSGWRLFVKIS | 2415 |
| array1.51 | VSGWRLFSKIS | 2416 |
| array1.52 | VSGWRLFRKIS | 2417 |
| array1.53 | VSGWRLFTKIS | 2418 |
| array1.54 | VSGWRLFNKIS | 2419 |
| array1.55 | VSGWRLFQKIS | 2420 |
| array1.56 | VSGWRLFKRIS | 2421 |
| array1.57 | VSGWRLFKQIS | 2422 |
| array1.58 | VSGWRLFKEIS | 2423 |
| array1.59 | VSGWRLFKAIS | 2424 |
| array1.60 | VSGWRLFKKVS | 2425 |
| array1.61 | VSGWRLFKKLS | 2426 |
| array1.62 | VSGWRLFKKAS | 2427 |
| array1.63 | VSGWRLFKKFS | 2428 |
| array1.64 | VSGWRLFKKES | 2429 |
| array1.65 | VSGWRLFKKTS | 2430 |
| array1.66 | VSGWRLFKKIL | 2431 |
| array1.67 | VSGWRLFKKIA | 2432 |
| array1.68 | VSGWRLFKKIE | 2433 |
| array1.69 | VSGWRLFKKIV | 2434 |
| array1.70 | VSGWRLFKKIG | 2435 |
| array1.71 | VSGWRLFKKIH | 2436 |
| array1.72 | VSGWRLFKKIT | 2437 |
| array1.73 | VVGYRLFKKIS | 2438 |
| array1.74 | VKGYRLFKKIS | 2439 |
| array1.75 | VIGYRLFKKIS | 2440 |
| array1.76 | VEGYRLFKKIS | 2441 |
| array1.77 | VAGYRLFKKIS | 2442 |
| array1.78 | VQGYRLFKKIS | 2443 |
| array1.79 | VHGYRLFKKIS | 2444 |
| array1.80 | VTAYRLFKKIS | 2445 |

TABLE 6-continued

Peptide Array 1

| | Sequence | SEQ ID NO. |
|---|---|---|
| array1.81 | VTSYRLFKKIS | 2446 |
| array1.82 | VTGYRIFKKIS | 2447 |
| array1.83 | VTGYRVFKKIS | 2448 |
| array1.84 | VTGYRTFKKIS | 2449 |
| array1.85 | VTGYRYFKKIS | 2450 |
| array1.86 | VTGYRKFKKIS | 2451 |
| array1.87 | VTGYRFFKKIS | 2452 |
| array1.88 | ISGWRLMKNIS | 2453 |
| array1.89 | ASGWRLMKKES | 2454 |
| array1.90 | VSGWRLMKKVS | 2455 |
| array1.91 | ISGWRLLKNIS | 2456 |
| array1.92 | ASGWRLLKKES | 2457 |
| array1.93 | VSGWRLLKKVS | 2458 |
| array1.94 | ISGWRLAKNIS | 2459 |
| array1.95 | ASGWRLAKKES | 2460 |
| array1.96 | VSGWRLAKKVS | 2461 |

Example 95

Solubility of NLpoly Variants

Figure 91:
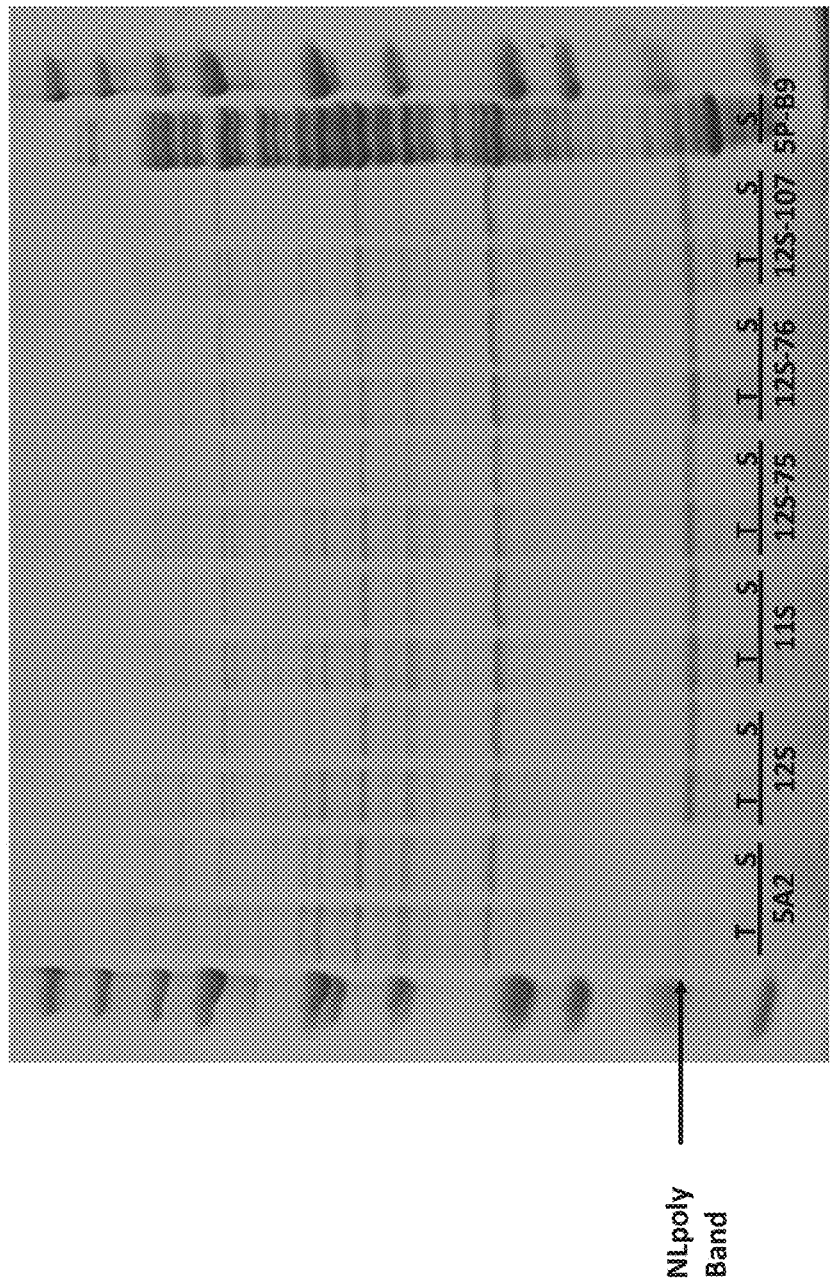
FIG. 91 shows an image of a protein gel of total lysates and the soluble fraction of the same lysate for NLpoly variants.

A single NLpoly 5A2, 12S, 11S, 12S-75, 12S-107 or 5P-B9 colony was inoculated into 5 mL LB culture and incubated at 37° C. overnight with shaking. The overnight culture was diluted 1:100 into fresh LB and incubated at 37° C. for 3 hrs with shaking. Rhamnose was added to the cultures to 0.2% and incubated 25° C. overnight with shaking. 900 ul of these overnight cultures were mixed with 100 uL 10× FastBreak Lysis Buffer (Promega Corporation) and incubated for 15 min at RT. A 75 uL aliquot (total) was removed from each culture and saved for analysis. The remaining culture from each sample was centrifuged at 14,000×rpm in a benchtop microcentrifuge at 4° C. for 15 min. A 75 uL aliquot of supernatant (soluble) was removed from each sample and saved for analysis. 25 uL of 4×SDS buffer was added to the saved aliquots and incubated at 95° C. for 5 min. 5 ul of each sample was loaded onto a 4-20% Tris-Glycine SDS gel and run at ~190V for ~50 min. The gel was stained with SimplyBlue Safe Stain and imaged on a LAS4000. FIG. 91 shows a protein gel of total lysates and the soluble fraction of the same lysate for the NLpoly variants. With the exception of 5A2, all variants exhibit a percentage of NLpoly in the soluble fraction.

Example 96

Solubility and Dissociation Constant of NLpoly Variants

A single NLpoly colony (listed in FIG. 92) was inoculated into 5 mL LB culture and incubated at 37° C. overnight with shaking. The overnight culture was diluted 1:100 into fresh LB and incubated at 37° C. for 3 hrs with shaking. Rhamnose was added to the cultures to 0.2% and incubated 25° C. overnight with shaking. 900 ul of these overnight cultures were mixed with 100 uL 10× FastBreak Lysis Buffer (Promega Corporation) and incubated for 15 min at RT. A 75 uL aliquot (total) was removed from each culture and saved for analysis. The remaining culture from each sample was centrifuged at 14,000×rpm in a benchtop microcentrifuge at 4° C. for 15 min. A 75 uL aliquot of supernatant (soluble) was removed from each sample and saved for analysis. 25 uL of 4×SDS buffer was added to the saved aliquots and incubated at 95° C. for 5 min. 5 ul of each sample was loaded onto a 4-20% Tris-Glycine SDS gel and run at ~190V for ~50 min. The gel was stained with SimplyBlue Safe Stain and imaged on a LAS4000.

Figure 92:
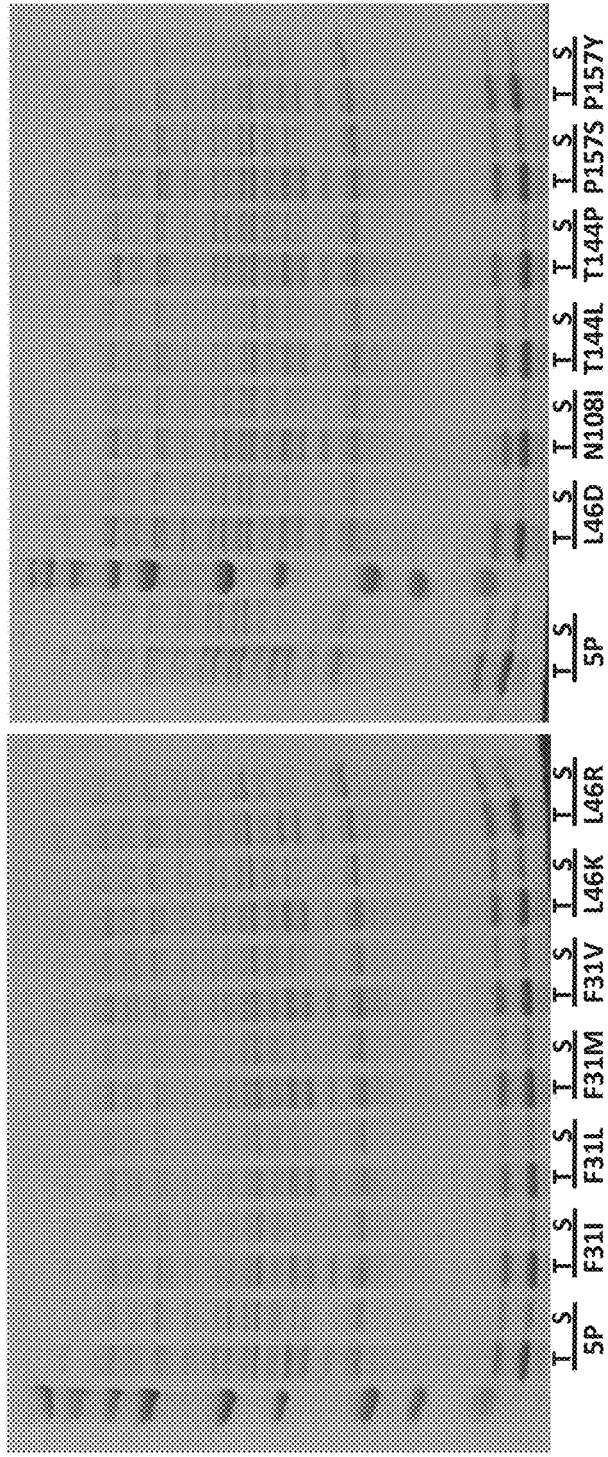
FIG. 92 shows an image of a protein gel of total lysates and the soluble fraction of the same lysate for NLpoly variants as well as a table containing the dissociation constants for the same variants.

FIG. 92 shows a protein gel of total lysates and the soluble fraction of the same lysate for NLpoly variants as well a table containing the dissociation constants for the same variants.

Example 97

Substrate Specificity for NLpoly 5P and 11S with NLpep79

Figure 93:
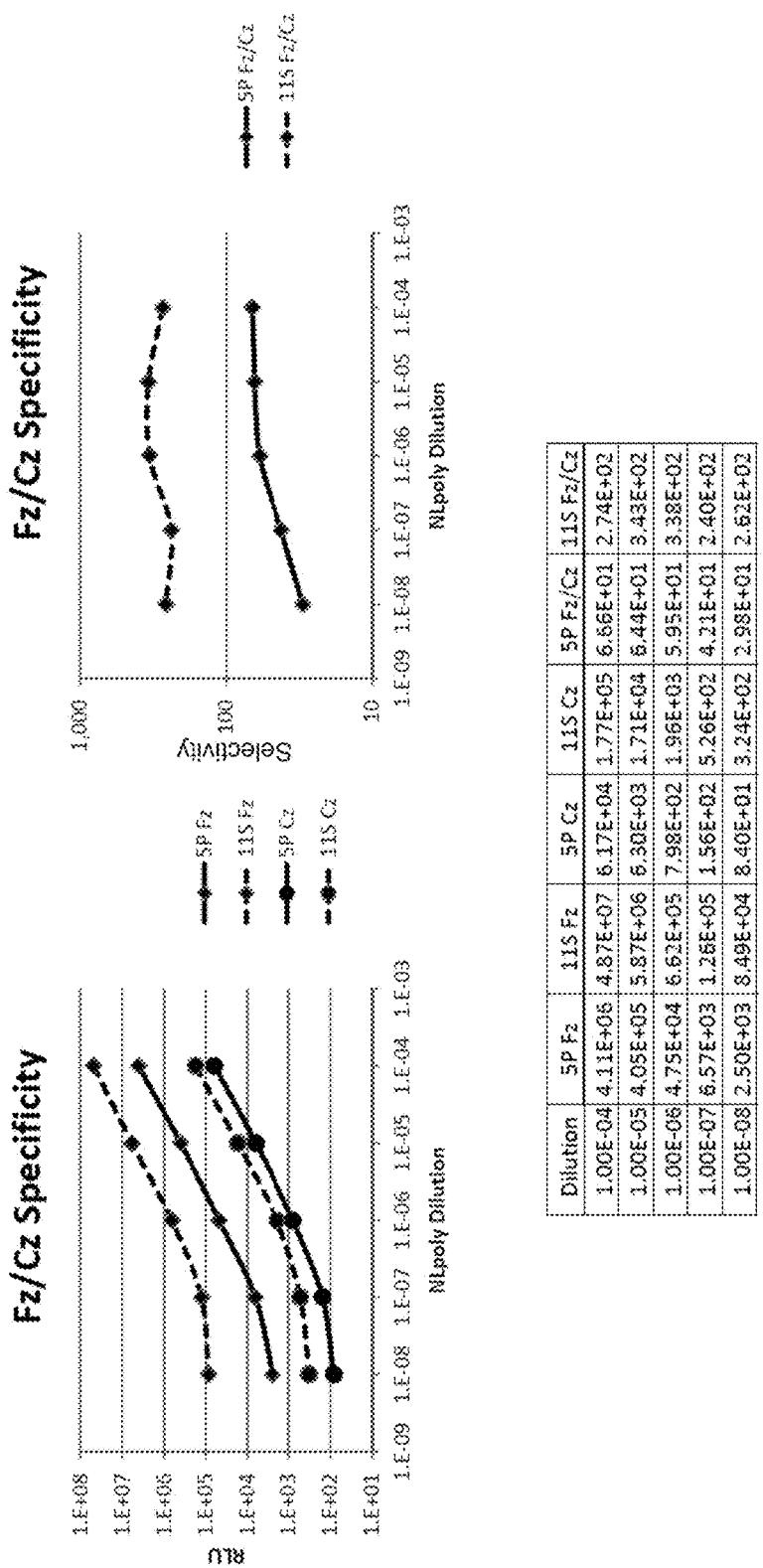
FIG. 93 shows the substrate specificity for NLpoly 5P and 11S with NLpep79 and demonstrates that NLpoly11S has superior specificity for furimazine than 5P.

E. coli clarified lysates were prepared for NLpoly 5P or 11S as described previously. The NLpoly lysates were then serially diluted in steps of 10-fold into PBS+0.1% PRIONEX. 25 uL NLpoly and 25 uL synthetic NLpep79 (400 nM, 4×) were mixed and incubated for 10 min at RT. 50 uL NANOGLO+100 uM Fz was added, incubated for 10 min at RT, luminescence measured on a GLOMAX Multi+ with 0.5 sec integration. FIG. 93 shows the substrate specificity for 5P and 11S with NLpep79 and demonstrates that 11S has superior specificity for furimazine than 5P.

Example 98

Solubility of NLpoly Variants from Various Steps of Evolution

A single NLpoly WT, 5A2, 5P, 8S or 11S colony was inoculated into 5 mL LB culture and incubated at 37° C. overnight with shaking. The overnight culture was diluted 1:100 into fresh LB and incubated at 37° C. for 3 hrs with shaking. Rhamnose was added to the cultures to 0.2% and incubated 25° C. overnight with shaking. 900 ul of these overnight cultures were mixed with 100 uL 10× FastBreak Lysis Buffer (Promega Corporation) and incubated for 15 min at RT. A 75 uL aliquot (total) was removed from each culture and saved for analysis. The remaining culture from each sample was centrifuged at 14,000×rpm in a benchtop microcentrifuge at 4° C. for 15 min. A 75 uL aliquot of supernatant (soluble) was removed from each sample and saved for analysis. 25 uL of 4×SDS buffer was added to the saved aliquots and incubated at 95° C. for 5 min. 5 ul of each sample was loaded onto a 4-20% Tris-Glycine SDS gel and run at ~190V for ~50 min. The gel was stained with SimplyBlue Safe Stain and imaged on a LAS4000.

Figure 104:
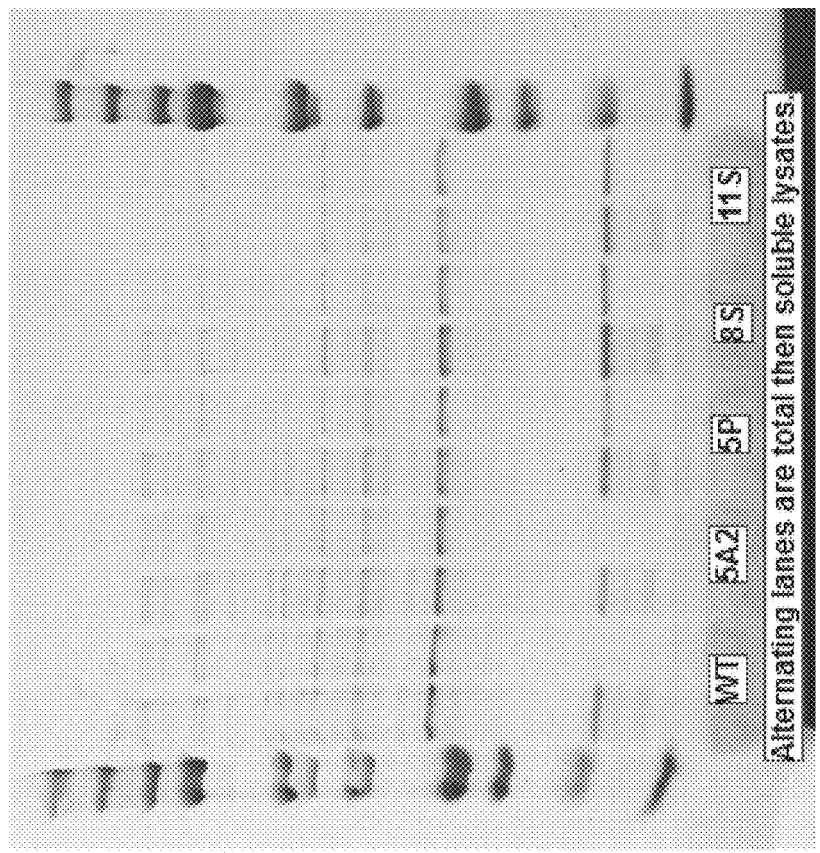
FIG. 104 shows an image of a protein gel of total lysates and the soluble fraction of the same lysate for NLpoly variants from various steps of the evolution process.

FIG. 104 shows a protein gel of total lysates and the soluble fraction of the same lysate for NLpoly variants from various steps of the evolution process. These results demonstrate that the solubility of NLpoly was dramatically increased in the evolution process.

Example 99

Chemical Labeling of Proteins

The non-luminescent peptides (NLpeps) of the present invention can be used to chemically label proteins. An NLpep of the present invention can be synthesized to contain a reactive group, e.g., biotin, succinimidyl ester, maleimide, etc., and attached (e.g., conjugated, linked, labeled, etc.) to a protein, e.g., antibody. The NLpep-labeled protein, e.g., NLpep-antibody, can then be used in a variety of applications, e.g., ELISA. The interaction/binding of the NLpep-labeled protein, e.g., NLpep-antibody, to its target/binding partner would be detected by adding an NLpoly of the present invention and NANOGLO assay reagent. The luminescence generated by the interaction of the NLpep-labeled protein and NLpoly would correlate to the interaction of the NL-labeled protein to its target/binding partner. This concept could allow for multiple NLpeps to be attached to a single protein molecule thereby resulting in multiple NLpep-labeled protein/NLpoly interactions leading to signal amplification.

Example 100

Detection of Post-Translational Protein Modification Using HALOTAG-NLpep by Western Blotting Several proteins can be posttranslationally modified by AMPylation or ADP-ribosylation. In AMPylation, AMP is added to the target protein by a phosphodiester bond using ATP as the donor molecule. Similarly, in ADP-ribosylation, an ADP-ribose moiety is added to target proteins through a phosphodiester bond using NAD+ as the donor molecule. It has been shown that the N6-position of both ATP and NAD+ can be used to tag linkers without affecting the posttranslational event. If a N6-modified chloroalkane-ATP or -NAD+ is used to perform the AMPylation or ADP-ribosylation reaction, the target proteins would be modified to contain the chloroalkane-ATP or -NAD+.

The N6-modified ATP/NAD has been used in combination with click-chemistry to develop in-gel fluorescent-based detection systems. Detection of these post-translational modifications by western blotting techniques requires antibodies, which are often not specific or not available. An alternative approach could be to combine the properties of HALOTAG technology and the high luminescence of NANOLUC luciferase (NL).

Upon post-translational modification of target proteins with chloroalkane-ATP (for AMPylation) or chloroalkane-NAD+(for ADP-ribosylation) using either cell lysate or purified proteins, samples can be resolved by SDS-PAGE and transferred to PVDF membrane. Following blocking, the blot can be incubated with HALOTAG-NLpep. HALOTAG will bind to the post-translationally-modified proteins. In the next step, the NLpoly and furimazine could be added to the blot to detect the bioluminescence. This detection method is an alternative to a chemiluminescent-based approach for detection of western blots. A chemiluminescent-based approach could involve incubation HALOTAG-protein G fusions (as a primary) in the next step any secondary antibody-linked to HRP could be used followed by ECL reaction.

Example 101

Post Translational Modification Assays

Post translational modifications (PTMs) of proteins are central to all aspects of biological regulation. PTMs amplify the diverse functions of the proteome by covalently adding functional groups to proteins. These modifications include phosphorylation, methylation, acetylation, glycosylation, ubiquitination, nitrosylation, lipidation and influence many aspects of normal cell biology and pathogenesis. More specifically, histone related PTMs are of great importance. Epigenetic covalent modifications of histone proteins have a strong effect on gene transcriptional regulation and cellular activity. Examples of post translational modification enzymes include but not limited to, Kinases/Phosphatases, Methyltransferases (HMT)/Demethylases (HDMT), Acetyltransferases/Histone Deacetylases, Glycosyltransferases/Glucanases and ADP-Ribosyl Transferases. Under normal physiological conditions, the regulation of PTM enzymes is tightly regulated. However, under pathological conditions, these enzymes activity can be dysregulated, and the disruption of the intracellular networks governed by these enzymes leads to many diseases including cancer and inflammation.

The non-luminescent peptides (NLpep) and non-luminescent polypeptides (NLpoly) of the present invention can be used to determine the activity of PTM enzymes by monitoring changes in covalent group transfer (e.g. phosphoryl, acetyl) to a specific peptide substrate linked to an NLpep of the present invention. The NLpep will be linked through peptide synthesis to small PTM enzyme specific peptide and used as a substrate for the PTM enzyme.

A) PTM Transferase Assays (HAT)

Once the PTM enzyme reaction has occurred, an aminopeptidase can be used to degrade the non-modified peptide (NLpep; control). The modified (acetylated) peptide (NLpep-PTM enzyme substrate) would be degraded at a very slow rate or would not be degraded at all as the aminopeptidase activity is known to be affected by a PTM. Once the aminopeptidase reaction is complete, the NLpoly is added with the NANOGLO assay reagent containing Furimazine. Luminescence would be generated from the sample where PTM occurred via the interaction of the NLpep and NLpoly. If no PTM occurred, the NLpep would be degraded, and no interaction between the NLpep and NLpoly would occur, thereby no luminescence would be generated. This concept is exemplified in FIG. 197 for a general transferase enzyme concept and in FIG. 145 for H3K4/9 acetyltransferases.

The reaction would be performed under optimal enzyme reaction condition using the histone peptide substrate linked to NLpep of the present invention and Acetyl-CoA or SAM as the acetyl or methyl group donor. A buffer containing aminopeptidase or a mixture of aminopeptidases would be added to degrade specifically all the non-modified substrates. A buffer containing a NLpoly of the present invention and an aminopeptidase inhibitor would be added. NANOGLO assay reagent would be added, and luminescence detected.

Luminescence generated would be proportional to the amount of non-degraded NLpep present, and therefore would correlate with the amount of methylated or acetylated substrates, thereby indicating the amount of methyl or acetyl transferase activity. The assay can also be applied to PTM such as phosphorylation, glycosylation, ubiquitination, nitrosylation, and lipidation.

B) PTM Hydrolase Assays (HDMT)

In a similar concept to A) can be used for Histone Demethylases (HDMT). However, instead of an aminopeptidase, a PTM-specific antibody can be used to create activity interference. An NLpep of the present invention could be linked through peptide synthesis to small methylated peptide and used as a substrate for the hydrolase. Once a hydrolase reaction has been completed, an anti-methyl antibody can be added to the reaction. This antibody will bind specifically to the methylated peptide (control). The peptide product generated by the HDMT will not bind to the antibody. Then, an NLpoly of the present invention can be added. If the antibody interferes with the interaction of NLpep and NLpoly, no luminescence will be generated. If there was hydrolysis of the PTM by the demethylase, the NLpep and NLpoly will interact, and luminescence will be generated. This concept is exemplified in FIG. 198 for a general hydrolase enzyme concept and in FIG. 146 H3K4/9 demethylases.

The concept of aminopeptidase degradation of the non-modified substrate can also be used for a hydrolase assay except it would be a loss of signal assay instead of a gain of signal. The reaction would be performed under optimal enzyme reaction condition using a modified (methylated or acetylated) histone peptide substrate linked to an NLpep of the present invention. A buffer containing an antibody capable of recognizing the methyl or acetyl group would be added. A buffer containing an NLpoly of the present invention would be added. The NLpoly would interact with NLpep not bound to the antibody. NANOGLO assay reagent would be added, and luminescence detected. The luminescence generated would be proportional to the amount of NLpep not bound to the antibody, and therefore would correlate with the amount of demethylated or deacetylated substrate, thereby indicating the amount of demethylase or deacetylase activity. Both hydrolase assay concepts can also be applied to PTM hydrolases such as phosphatases, glucanases and deubiquitinases.

In another version of these concepts, the PTM transfer or hydrolysis on the peptide-NLpep would be alone sufficient to reduce or enhance the interaction of NLpep with NLpoly and therefore decrease or increase the luminescence signal without the need of aminopeptidase or antibody.

The method of the present invention was used to assay a representative transferase, the Tyrosine Kinase SRC using the following NLpep-SRC substrate peptide: YIYGAFKRRGGVTGWRLCERILA (SEQ ID NO: 2586). SRC enzyme was titrated in 10 µl Reaction Buffer A (40 mM Tris 7.5, 20 mM MgCl2 and 0.1 mg/ml BSA) in the presence of 1501 µM ATP and 2.5 µM NLpep-Src substrate and incubated for 1 hour at 23° C. After incubation, 10 µl of Amino-peptidase M (APM) reagent (40 mM Tris 7.5, 0.1 mg/ml BSA and 50 mU APM) was added, mixed for 2 minutes on an orbital shaker, and then incubated at 37° C. for 2 hours. To the samples, 30 µl of NLpoly Reagent was added, and the samples were incubated at room temperature. NLpoly Reagent contained the NLpoly fragment and an Aminopeptidase inhibitor. After 30 minutes, 50 µl NANO-GLO assay reagent was added and the luminescence was recorded after 3 minutes on a luminometer. It was found that an increase in SRC kinase enzyme activity is correlated with an increase in luminescence over background (FIG. 199). Only background activity was found when SRC was not present indicating that the non-phosphorylated NLpep-SRC substrate peptide was digested resulting in no light production by the NLpoly fragment, thus demonstrating use of the method of the present invention to monitor the activity of a transferase enzyme such as a kinase.

Example 102

Detection of Specific RNAs (Noncoding RNA or mRNA) of Interest in Mammalian Cells, Cell Lysate or Clinical Sample The non-luminescent peptide (NLpep) and non-luminescent polypeptide (NLpoly) of the present invention can be tethered to an RNA binding domain (RBD) with engineered sequence specificity. The specificity of the RBD can be changed with precision by changing unique amino acids that confers the base-specificity of the RBD. An example of one such RBD is the human *pumilio* domain (referred here as PUM). The RNA recognition code of PUM has been very well established. PUM is composed of eight tandem repeats (each repeat consists of 34 amino acids which folds into tightly packed domains composed of alpha helices). Conserved amino acids from the center of each repeat make specific contacts with individual bases within the RNA recognition sequence (composed of eight bases). The sequence specificity of the PUM can be altered precisely by changing the conserved amino acid (by site-directed mutagenesis) involved in base recognition within the RNA recognition sequence. For detection of specific RNAs in the cell, PUM domains (PUM1 and PUM2) with customized sequence specificities for the target RNA can be tethered to a NLpep and NLpoly of the present invention (e.g., as a genetic fusion protein via genetic engineering) and can be expressed in mammalian cells. PUM1 and PUM2 are designed to recognize 8-nucleotide sequences in the target RNA which are proximal to each other (separated by only few base pairs, determined experimentally). Optimal interaction of PUM1 and PUM2 to their target sequence is warranted by introducing a flexible linker (sequence and length of the linker to be determined experimentally) that separates the PUM and the non-luminescent peptide and non-luminescent polypeptide. Binding of the PUM1 and PUM2 to their target sequence will bring the NLpep and NLpoly into close proximity in an orientation that results in a functional complex formation capable of generating bioluminescent signal under our specific assay condition. A functional bioluminescent complex would not be generated in the absence of the RNA target due to the unstable interaction of the NLpep and NLpoly pairs that constitutes the complex.

A similar strategy can also be used for detecting RNA in clinical sample in vitro. The NLpep-PUM fusion proteins with customized RNA specificity can be expressed and purified from suitable protein expression system (such as *E. coli* or mammalian protein expression system). Purified components can be added to the biological sample along with suitable substrate and assay components to generate the bioluminescent signal.

Example 103

DNA Oligo-Based Detection of Specific RNA (Noncoding RNA or mRNA) in Clinical Sample or Mammalian Cell Lysate A non-luminescent peptide (NLpep) and non-luminescent polypeptide (NLpoly) of the present invention can be attached to oligonucleotides complementary to the target RNA with suitable linker (amino acids or nucleotides). Functional assembly of bioluminescent complex occurs only when sequence specific hybridization of DNA oligo to their target RNA brings the NLpep and NLpoly into close proximity in an ideal conformation optimal for the generation of a bioluminescent signal under the assay conditions. The detection can also be achieved through a three-component complementation system involving two NLpeps and a third NLpoly. For example, two NLpep-DNA conjugates will be mixed with the target RNA. Functional assembly of the bioluminescent complex is achieved by subsequent addition of the third NLpoly. Thus, if a detectable signal is produced under specific assay conditions using a clinical sample or cell lysate, the presence of target RNA in such a sample is inferred. Such assays are useful for detecting RNAs derived from infectious agents (viral RNAs) and specific RNA biomarkers (implicated in many disease conditions such as various forms of cancers, liver diseases, and heart diseases), and could provide a new avenue for diagnosis and prognosis of many disease conditions.

Example 104

In-Vivo Imaging

Biotechnology-derived products (Biologics), including antibodies, peptides and proteins, hold great promises as therapeutics agents. Unlike small molecule drugs, biologics are large molecules with secondary and tertiary structures and often contain posttranslational modifications. Internalization, intracellular trafficking, bio-distribution, pharmacokinetics and pharmacodynamics (PKIPD), immunogenicity, etc. of biologics differ significantly from small molecule drugs, and there is a need for new tools to 'track' these antibodies in vivo. Conventional chemical labeling with enzyme reporters (HRP, luciferase, etc.) or small fluorescent tags can significantly alter the therapeutic value of the biologics and are not ideal for in vivo imaging using biologics. Radioisotope-labeling for PET-based imaging is also not convenient.

The NLpolys and NLpeps described herein offer a novel solution for in vivo imaging of biologics. The NLpep can be genetically encoded into a biologic therapeutics without any synthetic steps. Genetic encoding allows precise control over amount of peptide per biologic molecule as well as its position, thereby minimizing any perturbation to its therapeutic value. For imaging, a NLpoly along with substrate, e.g., furimazine, can be injected into the animal. If the NLpep-biologic and NLpoly interact, luminescence would be generated. Alternatively, a transgenic animal expressing NLpoly can be used as a model system.

Example 105

BRET Applications

This concept fundamentally measures three moieties coming together. Two of the NLpolys and/or NLpeps form a complex, and the third moiety, which is either fluorescent or bioluminescent, provides an energy transfer component. If the complex formed is bioluminescent, both bioluminescence and energy transfer (i.e., BRET) can be measured. If the complex formed is fluorescent, the magnitude of energy transfer can be measured if the third component is a bioluminescent molecule.

A) This example demonstrates a fluorescent dye attached to a NLpep. Alternatively, a fluorescent protein could be fused, e.g., a fusion protein, with a NLpoly or NLpep (created from a genetic construct).

E. coli clarified lysate of NLpoly WT was prepared as described previously. 40 uL NLpoly WT lysate was mixed with 10 uL of PBI-4730 (NLpep1) or PBI-4877 (NLpep1-TMR) and incubated for 10 min at RT. 50 uL 100 uM furimazine in 50 mM HEPES pH 7.4 was added and incubated for 30 min at RT. Luminescence was measured over 400-700 nm on TECAN M1000.

FIG. 147 illustrates very efficient energy transfer from the NLPoly/NLPep complex (donor) to TMR (acceptor), and the corresponding red shift in the wavelength of light being emitted.

B) This example demonstrates using the BRET in detection, such as detecting small molecule concentration or enzymatic activity. Because energy transfer is strongly dependent on distance, the magnitude of energy transfer can often be related to the conformation of the system. For instance, insertion of a polypeptide that chelates calcium can be used to measure calcium concentration through modulation of energy transfer.

An enzyme that also changes the distance, either through causing a conformational change of the sensor as above or through cleavage of the sensor from the fluorescent moiety, can be measured through a system as described herein. A NLpoly or NLpep bound to a fluorescent moiety gives energy transfer when the NLpoly and NLpep interact. One example of this is a peptide sensor that has been made wherein the NLpep is conjugated to a fluorescent TOM dye via a DEVD linker (Caspase-3 cleavage site). When exposed to the NLpoly, energy transfer is observed. When exposed to Caspase-3, energy transfer is eliminated, but luminescence at 460 nm remains.

NLpoly 5A2 and NL-HT (NANOLUC fused to HALOTAG) were purified. 20 uL of 8 pM NL-HT was mixed with 20 uL of 100 nM PBI-3781 (See, e.g., U.S. patent application Ser. No. 13/682,589, herein incorporated by reference in its entirety) and incubated for 10 min at RT. 40 uL NANOGLO+100 uM furimazine was added, and luminescence measured over 300-800 nm on TECAN M 1000.

20 uL of 33 ng/uL NLpoly 5A2 was mixed with 20 uL of ~500 uM PBI-5074 (TOM-NCT-NLpep). 40 uL NANOGLO+100 uM furimazine was added, and luminescence measured over 300-800 nm on TECAN M 1000.

FIG. 148 illustrates energy transfer from the NLPoly/NLPep complex (donor) to TOM-dye (acceptor), and the corresponding red shift in the wavelength of light being emitted.

C) Ternary Interactions

The energy transfer with an NLpoly and NLpep can also be used to measure three molecules interacting. One example would be a GPCR labeled with NLpoly and a GPCR interacting protein with NLpep that forms a bioluminescent complex when they interact. This allows measurement of the binary interaction. If a small molecule GPCR ligand bearing an appropriate fluorescent moiety for energy transfer interacts with this system, energy transfer will occur. Therefore, the binary protein-protein interaction and the ternary drug-protein-protein interaction can be measured in the same experiment. Also, the fluorescent molecule only causes a signal when interacting with a protein pair, which removes any signal from the ligand interacting with an inactive protein (FIG. 149).

Example 106

6-Tetramethylrhodamine-PEG3-NH$_2$

To a solution of 6-Tetramethylrhodamine succinimidyl ester (0.25 g, 0.5 mmol) in DMF (5 mL), 1-Boc-4,7,10-trioxatridecan-1,13-diamine (0.15 g, 0.5 mmol) was added followed by diisopropylethylamine (0.25 mL, 1.4 mmol). After stirring for 16 h, the reaction was analyzed by HPLC to confirm complete consumption of the 6-tetramethylrhodamine succinimidyl ester. The reaction was concentrated to a pink film, which was dissolved in a combination of triisopropylsilane (0.2 mL) and trifluoroacetic acid (4 mL). The pink solution was stirred for 2 h, after which analytical HPLC confirmed complete consumption of starting material. The reaction was concentrated to dryness to provide crude 6-Tetramethylrhodamine-PEG3-NH2 as a pink film.
H-GVTGWRLCERILA-PEG-TMR (SEQ ID NO: 2578) (PBI-4877):

free N-terminus. The peptide was then cleaved from the resin and fully deprotected using trifluoroacetic acid (TFA) to provide a blue solid. This solid was purified with reverse phase HPLC using a gradient of ACN in 0.1% aqueous TFA to provide PBI 5074 as a blue powder: MS (M+Z/2) calcd 1238.9, found 1238.8.

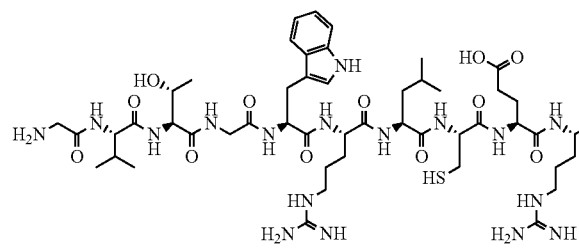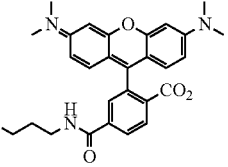

The fully protected peptide Boc-GVTGWRLCERILA-resin (SEQ ID NO: 2578) was synthesized by standard solid phase peptide synthesis using Fmoc techniques, then cleaved from the resin using dichloroacetic acid to liberate the fully protected peptide as a white solid. To a solution of 6-Tetramethylrhodamine-PEG3-NH2 (0.05 g, 0.08 mmol) in DMF (1.5 mL), this Boc-GVTGWRLCERILA-OH (SEQ ID NO: 2578) (0.2 g, 0.07 mmol), 1-hydroxyazabenzotriazole (11 mg, 0.08 mmol), 1-Ethyl-3-(3-dimethylaminopropyl)carbodiimide (15 mg, 0.08 mmol) and diisopropylethylamine (0.28 mL, 0.16 mmol) was added. After stirring for 30 min, the reaction was concentrated, and the resulting crude was partitioned between CH$_2$Cl$_2$ and water, the layers separated and the organic layer was washed with water and brine, dried over sodium sulfate and concentrated. The resulting pink solid was dissolved in a combination of triisopropylsilane (0.2 mL) and trifluoroacetic acid (4 mL). After stirring for 3 h, the reaction was concentrated, and the resulting pink film was purified with reverse phase HPLC using a gradient of ACN in 0.1% aqueous TFA to provide PBI 4877 as a pink powder: MS (M+) calcd 2088.5, found 2089.1.
TOM-DEVDGVTGWRLCERILA-OH(SEQ ID NO: 2579) (PBI-5074):

Example 107

Complementation Comparison Between a Synthetic, N-Terminal Fusion and C-Terminal Fusion of NLPep78

Fusions of NLpep78-HALOTAG (78-HT) and HALOTAG-NLPep78 (HT-78) were quantitated, with a GST-HALOTAG fusion (GST-HT) as a control, by labeling E. coli lysates with the HALOTAG-TMR ligand, separated by SDS-PAGE, and scanned on Typhoon. A standard curve was then created using known concentrations of GST-HT standard, and band intensities of 78-HT and HT-78 were used to determine their concentrations.

E. coli lysates containing NLpoly11S were diluted 1:10$^7$ into PBS pH 7+0.1% PRIONEX Serial dilutions of 78-HT, HT-78, and synthetic NLpep78 were made in PBS pH 7+0.1% PRIONEX. 20 uL NLpoly11S and 20 uL of one of the NLPep were mixed and incubated at ambient temperature for 5 minutes. 40 uL NANOGLO reagent (Promega Corporation)+100 uM Fz were added, and the samples incubates at ambient temperature for 5 min. Luminescence was measured on GLOMAX Multi+ using 0.5 s integration. Data was fit to one-site, specific binding using GraphPad Prism to determine Bmax and Kd.

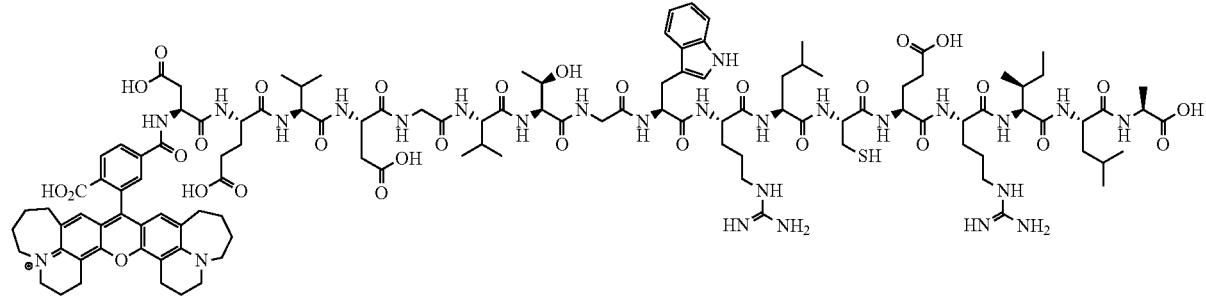 [SMILES: CC[C@H](C)[C@H](NC(=O)[C@H](CCCNC(=N)N)NC(=O)[C@H](CCC(=O)O)NC(=O)[C@H](CS)NC(=O)[C@H](CC(C)C)NC(=O)[C@H](CCCNC(=N)N)NC(=O)[C@H](Cc1c[nH]c2ccccc12)NC(=O)CNC(=O)[C@@H](NC(=O)[C@@H](NC(=O)CNC(=O)[C@H](CC(=O)O)NC(=O)[C@@H](NC(=O)[C@H](CCC(=O)O)NC(=O)[C@H](CC(=O)O)NC(=O)c1ccc(C(=O)O)c(C2=c3cc4c5c(c3Oc3c2cc2c6c3CCCN6CCCC2)CCC[N+]=5CCCC4)c1)C(C)C)C(C)C)[C@@H](C)O)C(=O)N[C@@H](CC(C)C)C(=O)N[C@@H](C)C(=O)O]

The fully protected peptide H-DEVDGVTGWRLCE-RILA-resin (SEQ ID NO: 2579) was synthesized by standard solid phase peptide synthesis using Fmoc techniques. While still on the resin, a solution of 6-TOM (PBI-3739) succinimidyl ester was added and allowed to react with the The results (FIG. 150) compare the binding of NLpoly11S to synthetic NLPep78 and NLPep78 at the N- or C-terminus of a fusion partner (HALOTAG). The binding affinities were not found to change significantly, but Bmax was reduced when NLPep78 was at the C-terminus.

Example 108

Complementation Comparison Between a Synthetic, N-Terminal Fusion and C-Terminal Fusion of NLPep79

Fusions of NLpep79-HALOTAG (79-HT) and HALOTAG-NLPep79 (HT-79) were quantitated, with a GST-HALOTAG fusion (GST-HT) as a control, by labeling E. coli lysates with the HALOTAG-TMR ligand, separated by SDS-PAGE, and scanned on Typhoon. A standard curve was then created using known concentrations of GST-HT standard, and band intensities of 79-HT and HT-79 were used to determine their concentrations.

E. coli lysates containing NLpoly11S were diluted 1:$10^7$ into PBS pH 7+0.1% PRIONEX. Serial dilutions of 79-HT, HT-79, and synthetic NLpep79 were made in PBS pH 7+0.1% PRIONEX. 20 uL NLpoly11S and 20 uL of one of the NLPep were mixed and incubated at ambient temperature for 5 minutes. 40 uL NANOGLO reagent (Promega Corporation)+100 uM Fz were added, and the samples incubates at ambient temperature for 5 min. Luminescence was measured on GLOMAX Multi+ using 0.5 s integration. Data was fit to one-site, specific binding using GraphPad Prism to determine Bmax and Kd.

The results (FIG. 151) compare the binding of NLpoly11S to synthetic NLPep79 and NLPep79 at the N- or C-terminus of a fusion partner (HALOTAG). The binding affinities were not found to change significantly, but Bmax was reduced when NLPep79 was at the C-terminus.

Example 109

Spectral Scan of NLpoly11S with NLPep86 Compared to PBI-4877 (NLPep1-fluorophore)

Purified NLpoly11S was diluted to 1 nM in PBS pH 7+0.01% PRIONEX+1 mM DTT. NLPep86 or PBI-4877 was diluted to 40 uM in PBS pH 7+0.01% PRIONEX+1 mM DTT. 25 uL NLpoly11S and 25 uL NLPep86 or PBI-4877 were mixed and then incubated at ambient temperature for 10 min. 50 uL buffer (PBS pH 7+0.01% PRIONEX+1 mM DTT)+100 uM Fz was then added. Luminescence was measured on Tecan Infinite M1000: 300-800 nm, every 5 nm, bandwidth 10 nm, gain 127, integration 0.5 s, z-position 22,000 um.

The results demonstrate (FIG. 152) that the NLPep can be conjugated to small molecules such as fluorescent dyes and retain interaction with NLpoly11S to produce luminescence. It also demonstrates efficient energy transfer and the ability to alter the emission spectra.

Example 110

Spectral Scan of NLpoly11S with NLPep86 Compared to PBI-5434 (Fluorophore-NLPep1)

Purified NLpoly11S was diluted to 1 nM in PBS pH 7+0.01% PRIONEX+1 mM DTT. NLPep86 or PBI-5434 was diluted to 40 uM in PBS pH 7+0.01% PRIONEX+1 mM DTT. 25 uL NLpoly11S and 25 uL NLPep86 or PBI-5434 were mixed and then incubated at ambient temperature for 10 min. 50 uL buffer (PBS pH 7+0.01% PRIONEX+1 mM DTT)+100 uM Fz was then added. Luminescence was measured on Tecan Infinite M1000: 300-800 nm, every 5 nm, bandwidth 10 nm, gain 127, integration 0.5 s, z-position 22,000 um.

The results demonstrate (FIG. 153) that the NLPep can be conjugated to small molecules such as fluorescent dyes and retain interaction with 11S to produce luminescence. This, along with the results with PBI-4877 in Example 109, also suggests that the terminus and/or the linker length used for the conjugation can significantly affect the energy transfer.

Example 111

Spectral Scan of NLpoly11S with NLPep86 Compared to PBI-5436 (Fluorophore-NLPep1)

Purified NLpoly11S was diluted to 1 nM in PBS pH 7+0.01% PRIONEX+1 mM DTT. NLPep86 or PBI-5436 was diluted to 40 uM in PBS pH 7+0.01% PRIONEX+1 mM DTT. 25 uL NLpoly11S and 25 uL NLPep86 or PBI-5436 were mixed and then incubated at ambient temperature for 10 min. 50 uL buffer (PBS pH 7+0.01% PRIONEX+1 mM DTT)+100 uM Fz was then added. Luminescence was measured on Tecan Infinite M1000: 300-800 nm, every 5 nm, bandwidth 10 nm, gain 127, integration 0.5 s, z-position 22,000 um.

The results demonstrate (FIG. 154) that the NLPep can be conjugated to small molecules such as fluorescent dyes and retain interaction with 11S to produce luminescence. It also demonstrates efficient energy transfer and the ability to alter the emission spectra.

Example 112

Comparison of Km Values for 11S with Various NLPeps in Affinity Buffer

Purified NLpoly11S was diluted to 40 pM in PBS pH 7+0.01% PRIONEX+1 mM DTT+0.005% Tergitol (affinity buffer) or NANOGLO assay reagent (Promega Corporation). NLPeps (NLpep86, 78, 99, 101, 104, 128 and 114) were diluted to 400 uM (NLPep to 1 mM) in affinity buffer or NANOGLO assay reagent. 300 uL NLpoly11S and 300 uL of an NLPep were mixed and incubated at ambient temperature for 30 min. 50 ul was then added to a well of white 96-well plates. 50 ul affinity buffer+2×Fz (12.5 uM diluted 2-fold 7 times) or 50 ul NANOGLO+2×Fz (100 uM diluted 2-fold 7 times) was added to each well, and luminescence measured on a GLOMAX Multi+ using 0.5 s integration. Km was determined using GraphPad Prism, Michaelis-Menten.

The results demonstrate substrate binding in affinity buffer (FIG. 155) or NANOGLO assay buffer (FIG. 156) to the complex between NLpoly11S and various NLPeps. The determined Km values do not fluctuate significantly with the indicated NLPeps.

Example 113

NLPep Binding Affinity to NLpoly11S at Various Concentrations of Furimazine Purified NLpoly156 and NLpoly11S to 40 pM in affinity buffer (PBS pH 7+0.01% PRIONEX+1 mM DTT+0.005% tergitol). Synthetic NLPep1 (WT) was diluted to 560 uM for NLpoly156 or 80 uM for NLpoly11S in affinity buffer and then serially diluted 3-fold to make 8 concentrations. 350 uL NLPep1 and 350 uL NLPoly156 or 11S were mixed and then incubated at ambient temperature for 30 min. 50 uL was then aliquoted into a well of white 96-well assay plate. Fz was added to affinity buffer to 40, 20, 10, 5, 2.5 and 1.25 uM, 50 uL Fz/affinity buffer added to each well and incubated at ambient temperature for 2 min. Luminescence was measured on a GLOMAX Multi+ with 0.5 s integration. GraphPad Prism and 1-site specific binding was used to calculate Kd at each concentration of Fz.

The results (FIG. 157) indicate the change in affinity (NLPoly/NLPep) with increasing concentrations of Fz.

Example 114

Furimazine Km Values for NLpoly156/NLPep1 and NLpoly11S/NLPep1 at Various Concentrations of NLPep Purified NLpoly156 and NLpoly11S were diluted to 40 pM in affinity buffer (PBS pH 7+0.01% PRIONEX+1 mM DTT+0.005% tergitol). Synthetic NLPep1 (WT) was diluted to 560 uM for NLpoly156 or 80 uM for NLpoly11S in affinity buffer and then serially diluted 3-fold to make 8 concentrations. 50 uL was then aliquoted into a well of white 96-well assay plate. Fz was added to affinity buffer to 40, 20, 10, 5, 2.5 and 1.25 uM, 50 uL Fz/affinity buffer added to each well and incubated at ambient temperature for 2 min. Luminescence was measured on a GLOMAX Multi+ with 0.5 s integration. GraphPad Prism and 1-site specific binding was used to calculate Kd at each concentration of NLPep1.

The results (FIG. 158) indicate the change in affinity (NLPoly/NLPep) with increasing concentrations of NLPep1.

Example 115

Comparison of Maximal Activity for NLPoly156/NLPep1, NLPoly 1S/NLPep1, and NANOLUC Luciferase Purified NLPoly156, NLPoly11S. or NANOLUC luciferase (Nluc) were diluted to 40 pM in affinity buffer (PBS pH 7+0.01% PRIONEX+1 mM DTT+0.005% tergitol). Synthetic NLPep 1 (WT) was diluted to 560 uM for NLPoly156 or 80 uM for NLPoly11S in affinity buffer and then serially diluted 3-fold to make 8 concentrations. 350 uL NLPep1 (or affinity buffer) and 350 uL NLPoly (or Nluc) were mixed and then incubated at ambient temperature for 30 min. 50 uL was then aliquoted into a well of white 96-well assay plate. Fz was added to affinity buffer to 40, 20, 10, 5, 2.5 and 1.25 uM, 50 uL Fz/affinity buffer added to each well and incubated at ambient temperature for 2 min. Luminescence was measured on a GLOMAX Multi+ with 0.5 s integration. GraphPad Prism and Michaelis-Menton equation was used to calculate Vmax at each concentration of NLPep (input calculated Vmax values at each concentration of NLPep1 into 1-site specific binding to calculate Bmax). GraphPad Prism and 1-site specific binding was used to calculate Bmax at each concentration of Fz (input calculated Bmax values at each concentration of Fz into Michaelis-Menton equation to calculate Vmax).

The results (FIG. 159) demonstrate the maximal activity of NLPoly156 or NLPoly11S upon activation by NLPep1 to the maximal activity of NANOLUC luciferase.

Example 116

Luminescent Values Resulting from Titrating NLpoly11S with Various NLPeps

Purified NLPoly11S was diluted to 40 pM in PBS pH 7+0.01% PRIONEX+1 mM DTT+0.005% Tergitol (affinity buffer). Synthetic NLPeps (NLPep86, 78, 79, 99, 101, 104, 114, 128 or wt) were diluted in affinity buffer as follows: NLPep86=60 nM, NLPep78=280 nM, NLPep79=800 nM, NLPep99=4 uM, NLPep101=34 uM. NLPep104=20 uM, NLPep128=4 uM, NLPep114=4.48 mM and NLPepWT=20 uM. 25 uL NLPoly11S and 25 uL an NLPep were mixed and then incubated at ambient temperature for 30 min. 50 ul affinity buffer+20 uM Fz was then added to each mixture, and luminescence measured on a GLOMAX Multi+ using 0.5 s integration. Bmax and Kd values were determined using GraphPad Prism and 1 site specific binding.

The results (FIG. 160) demonstrate ~100,000-fold range of affinities using NLPoly11S and various NLPeps. Minimal loss in Bmax was observed between the high affinity and low affinity NLPeps.

Example 117

Western Blot of NLPoly156, NLPoly11S, and NANOLUC Luciferase after Transfection into HEK293T Cells On day 1, a transfection mixture of 2 ng NLPoly156, NLPoly11S or NANOLUC luciferase (Nluc) DNA, 1 ug pGEM3Zf(+) carrier DNA, 4 ul Fugene HD (Promega Corporation) and Phenol red-free OptiMEM to 100 ul was made and incubated at RT for 10 minutes. The transfection mixture was then transferred to one well of 6 well plate, and 2 ml of HEK293T cells at 400,000 cells/ml (800.000 cells total) was added. The cells were incubated overnight at 37° C.

On day 2, the cells were washed with phenol red-free DMEM, 500 uL phenol red-free DMEM added to each well, and the cells frozen at −70° C. for at least 30 min. The cells were then thawed, 500 uL transferred to microcentrifuge tube, and 20 ul mixed with 80 uL of 1.25×SDS loading buffer and incubated at 95° C. for 5 min. 10 ul was loaded onto 10% Bis-Tris NuPAGE gel with MES running buffer. Protein was transferred to PVDF using iBlot, and the membrane washed in methanol. The membrane was then blocked in TBST+5% BSA for 1 hr at ambient temperature, washed 3 times in TBST and then incubated with 10 mL TBST+2 uL rabbit anti-Nluc polyclonal antibody+2 uL rabbit anti-β-actin polyclonal antibody (Abcam #ab8227) at 4° C. overnight.

On day 3, the membrane was washed 3 times in TBST, incubated with 10 mL TBST+2 uL anti-rabbit HRP conjugated antibody for 1 hr at ambient temperature, washed again 3 times with TBST and incubated with 12 mL ECL Western Blotting Substrate for 1 min. Chemiluminescence was imaged with LAS 4000 Image Quant.

The results (FIG. 161) show the expression level of NLPoly compared to full-length NANOLUC luciferase. NLPoly156 does not express as well as NANOLUC luciferase (Nluc), whereas NLPoly11S expresses similarly to Nluc.

Example 118

Determination of the Influence of NLPoly11S/NLPep114 Affinity on the Interaction Between a β-Lactamase (SME) and β-Lactamase Inhibitory Protein (BLIP) and Comparison Between Affinity Values Measured Through 11S/114 and β-Lactamase Activity Protein Purification
pF1K-signal-6H-SME, pF1K-signal-6H-SME-11S, pF1K-signal-6H-BLIPY50A. and pF1K-signal-6H-

BLIPy50A-114 (Promega Flexi vectors for T7 promoter-based expression of recombinant protein in E. coli; the signal refers to the native signal peptide for either SME or BLIP) were induced with rhamnose to express in the periplasm of KRX cells at 25° C. for 18-20 hrs. Cells were pelleted and resuspended in B-Per lysis reagent (Pierce; 1/50th culture volume) and incubated at ambient temperature for 15 min. Lysate was then diluted by addition of 1.5× volume 20 mM Tris pH 8+500 mM NaCl and centrifuged at 12,000×g for 10 min. The supernatant was transferred to a clean tube, 1 mL RQ1 DNase (Promega Corporation) added and centrifuged again at 12,000×g for 10 min. Supernatant was purified over HisTALON column Clontech) with 25 mM Tris pH 8 and 500 mM NaCl loading buffer and eluted with 25 mM Tris pH 8, 500 mM NaCl and 50 mM imidazole. Eluted protein was dialyzed into 25 mM Tris pH 7.5 and 25 mM NaCl and purified over HiTrap Q FF column (GE Healthcare) with 25 mM Tris pH 7.5 and 25 mM NaCl loading buffer and eluted with 25 mM Tris pH 7.5 and 125 mM NaCl. Ionic strength was adjusted to final concentration of 150 mM NaCl, and concentrated using a VivaSpin concentrator.

Assay

BLIPY50A and BLIPY50A-114 were diluted to 312.5 nM in affinity buffer (PBS pH 7 0.01% PRIONEX 0.005% tergitol 1 mM DTT), and then serially dilute 1.5-fold. SME and SME-11S were diluted to 0.2 nM in affinity buffer. 11.11 uL SME and 88.89 uL BLIP were mixed and then incubated at ambient temperature for 2 hrs. 90 uL of the mixture was transferred to a clear 96-well plate with 10 uL of 100 uM Nitrocefin (Calbiochem in affinity buffer). 90 uL of SME-11S/BLIPY50A-114 was transferred to a white 96-well plate with 10 uL of 100 uM Fz (in affinity buffer). Absorbance (nitrocefin) was measured at 486 nm every 15 sec over 30 min, and luminescence (Fz) was measure every 2 min over 30 min.

For nitrocefin, initial velocities were fit using Excel. Initial velocities vs. BLIP concentration were plotted. Fit Ki using $E\_free = [E] - ([E\_0] + [I\_0] + K\_app - \sqrt{(([E\_0] + [I\_0] + K\_app)^2 - (4[E\_0][I\_0]))})/2$ and $K\_app = K\_i(1 + ([S])/K\_M)$ For Fz, Kd using $RLU = (Bmax \times [BLIP-14])/([BLIP-114] + K\_D)$ was fit.

The results (FIG. 162) compares the affinity of a protein interaction (the β-lactamase SME and its inhibitor BLIPY50A) as unfused proteins to the affinity when NLPoly and NLPep are fused to them and demonstrates the affinity between NLPoly11S and NLPep114 does not result in an increased apparent affinity for the SME/BLIPY50A interaction. This also demonstrates the use of NLPoly11S and NLPep114 to measure an equilibrium binding constant for a protein interaction, and the affinity measured through NLPoly11S and NLPep 114 is consistent with the affinity measured by activity of the target protein (SME).

Example 119

Comparison of Luminescence Generated by Cells Expressing Different Combinations of FRB-NLPoly11S with FKBP-NLPep 101 and 111-136

HEK293T cells (20,000) were reverse-transfected into wells of opaque 96-well assay plates with a total of 1 ng pF4A Ag FRB-NLpoly11S and pF4A Ag FKBP-NLpep101 or 111-136 plasmid DNA using FuGENE HD at a DNA-to-FuGENE ratio of 1 to 8. pGEM-3Zf(+) DNA was added to bring total DNA in each transfection to 1 g. Twenty-four hours-post transfection, cells were washed with PBS and then incubated in phenol red-free OptiMEMI with or without 50 nM rapamycin for 1.5 h. 10 pM furimazine substrate (final concentration) with or without 50 nM rapamycin in OptiMEMI was added directly to each well and incubated at room temperature for 5 min. Luminescence was then read on a GLOMAX Multi with 0.5 s integration time.

FIG. 163 demonstrates that, of tested combinations, NLpoly11S with NLpep 114 shows the greatest rapamycin induction and one of the strongest rapamycin-specific luminescent signals.

Example 120

Comparison of Luminescence Generated by Cells Expressing Different Combinations of FRB-NLpoly11S with FKBP-NLpep114 and 137-143

HEK293T cells (20,000) were reverse-transfected into wells of opaque 96-well assay plates with a total of 1 ng pF4A Ag FRB-NLpoly11S and pF4A Ag FKBP-NLpep114 or 137-143 plasmid DNA using FuGENE HD at a DNA-to-FuGENE ratio of 1 to 8. pGEM-3Zf(+) DNA was added to bring total DNA in each transfection to 1 µg. Twenty-four hours post transfection, cells were washed with PBS and then incubated in phenol red-free OptiMEMI with or without 50 nM rapamycin for 1.5 h. 10 pM furimazine substrate (final concentration) with or without 50 nM rapamycin in OptiMEMI was added directly to each well and incubated at room temperature for 5 min. Luminescence was then read on a GLOMAX Multi with 0.5 s integration time.

FIG. 164 demonstrates that, of tested combinations, NLpoly11S with NLpep114 shows the greatest rapamycin induction and one of the strongest rapamycin-specific luminescent signals.

Example 121

Rapamycin Dose Response Curves of Cells Expressing FRB-NLpoly11S and FKBP-NLpep78/79/99/101/104/114/128

HEK293T cells (20.000) were reverse-transfected into wells of opaque 96-well assay plates with a total of 0.1 ng pF4A Ag FRB-NLpoly11S and pF4A Ag FKBP-NLpep78/79/99/101/104/128 plasmid DNA using FuGENE HD at a DNA-to-FuGENE ratio of 1 to 8. pGEM-3Zf(+) DNA was added to bring total DNA in each transfection to 1 µg. Twenty-four hours post transfection, cells were washed with PBS and then incubated in phenol red-free OptiMEMI with 0 to 300 nM rapamycin for 2 h. 10 pM furimazine substrate (final concentration) with 0 to 300 nM rapamycin in OptiMEMI was added directly to each well and incubated at room temperature for 5 min. Luminescence was then read on a GLOMAX Multi with 0.5 s integration time. Graphpad Prism was used to fit data to sigmoidal curve and calculate EC50 values.

FIG. 165 shows a sigmoidal dose response to rapanmycin for NLpoly11S with NLpep78/79/99/101/104/114/128. Of the combinations plotted, NLpoly11S with NLpep114 shows the greatest dynamic range.

Example 122

Response of Cells Expressing FRB-NLpoly11S and FKBP-78/79/99/101/104/114/128 to the Rapamycin Competitive Inhibitor FK506

HEK293T cells (20,000) were reverse-transfected into wells of opaque 96-well assay plates with a total of 0.1 ng pF4A Ag FRB-NLpoly11S and pF4A Ag FKBP-NLpep78/ 79/99/101/104/114/128 plasmid DNA using FuGENE HD at a DNA-to-FuGENE ratio of 1 to 8. pGEM-3Zf(+) DNA was added to bring total DNA in each transfection to 1 µg. Twenty-four hours post transfection, cells were washed with PBS and then phenol red-free OptiMEMI with 10 nM rapamycin was added for 2 h. FK506 inhibitor in OptiMEM was added to cells at final concentrations of 0 to 50 pM and incubated for 3 h. Furimazine in OptiMEM was added to cells for a final concentration of 10 pM on cells. Luminescence was immediately read on a GLOMAX Multi with 0.5 s integration time. Graphpad Prism was used to plot data, fit to a sigmoidal curve, and calculate IC50 values.

FIG. 166 demonstrates dose-dependent decreases in rapamycin-induced signal of FRB-NLpoly11S and FKBP-78/79/99/101/104/114/128 with the rapamycin competitive inhibitor, FK506.

Example 123

Comparison of Luminescence Generated by Cells Transfected with Different Ratios of FRB-NLpoly11S and FKBP-NLpep114

HEK293T cells (20,000) were reverse-transfected into wells of opaque 96-well assay plates with 1 ng pF4A Ag FRB-NLpoly11S and 0.01, 0.1, 1, 10, or 100 ng pF4A Ag FKBP-NLpep114 plasmid DNA using FuGENE HD at a DNA-to-FuGENE ratio of 1 to 8. HEK293T cells (20,000) were also reverse transfected with 1 ng pF4A Ag FKBP-NLpep114 and 0.01, 0.1, 1, 10, or 100 ng pF4A Ag FRB-NLpoly11S. In both situations, pGEM-3Zf(+) DNA was added to bring total DNA in each transfection to 1 µg. Twenty-four hours post transfection, cells were washed with PBS and then incubated in phenol red-free OptiMEMI with or without 50 nM rapamycin for 1.5 h. 10 pM furimazine substrate (final concentration) with or without 50 nM rapamycin in OptiMEMI was added directly to each well and incubated at room temperature for 5 min. Luminescence was then read on a GLOMAX Multi with 0.5 s integration time.

FIG. 167 demonstrates that a DNA ratio of 1:1 generated the greatest rapamycin induction, although a significant induction was observed at all DNA ratios tested.

Example 124

Comparison of Luminescence Generated by Cells Expressing NLpoly11S/NLpep114 Fusions of FRB/FKBP in Different Orientations and with Different Linker Lengths HEK293T cells (20,000) were transfected into wells of 96-well plates with vectors expressing combinations of N- and C-terminal fusions of pF4Ag NLpoly11S and pF4Ag NLpep 114 with FRB or FKBP. In these constructs, NLpoly11S/NLpep114 were separated from their fusion partners with either a 4, 10, or 15 serine/glycine linker. 0.1 ng NLpoly11S and NLpep114 DNA was transfected per well at a DNA-to-FugeneHD ratio of 1 to 8. Twenty-four hours post transfection, cells were washed with PBS and then incubated in phenol red-free OptiMEMI with or without 50 nM rapamycin in OptiMEMI for 2 h. 10 pM Furimazine substrate was then added, and following a 5 min incubation at room temperature, the plate was read using a GLOMAX Multi with 0.5 s integration time.

FIG. 168 illustrates a rapamycin-specific increase in RLU regardless of fusion orientation or linker length.

Example 125

Comparison of Rapamycin Dose Response Curve and Time Course Generated by FRB-NLpoly11S/FKBP-NLpep114 and Split Firefly Complementation Systems HEK293T cells (800.000) were transfected into wells of 6-well plates with a total of 20 ng pF4A Ag FRB-NLpoly11S and pF4A Ag FKBP-NLpep 14 or 750 ng pF4A Ag N-Fluc (1-398)-FRB and FKBP-C-Fluc(394-544) using FuGENE HD at a DNA-to-FuGENE ratio of 1 to 4. pGEM-3Zf(+) DNA was added to bring total DNA in each transfection to 1 µg. Twenty-four hours post transfection, 20,000 cells were re-plated into wells of opaque 96-well assay plates and incubated an additional 24 h.

For dose response experiments (FIG. 169A), NLpoly11S/NLpep114-expressing cells were treated with 0-1 pM rapamycin in phenol red-free OptiMEMI for 3 h and then incubated with 10 pM furimazine for 5 min before recording luminescence on GLOMAX Multi. Cells expressing N-Fluc (1-398)/C-Fluc(394-544) were incubated with 0-1 pM rapamycin in phenol red-free for 2 h, followed by an additional 1 h incubation in the presence of 4 mM D-Luciferin, prior to recording luminescence on GLOMAX Multi.

For time course experiments (FIG. 169B), NLpoly11S/NLpep114-expressing cells were treated with 0 or 50 nM rapamycin in phenol red-free OptiMEMI was added via GLOMAX Multi injector, and luminescence was immediately measured. Cells expressing N-Flu(1-398)/C-Flu(394-544) were treated with 4 mM D-luciferin in phenol red-free OptiMEMI for 1 h followed by addition of 0 or 50 nM rapamycin via injector and measurement of luminescence by vMulti. Curves were fit using GraphPad Prism 6 software.

FIG. 169A-B demonstrate that both NLpoly11S/NLpep 114 and split firefly complementation systems respond in a rapamycin-dependent manner, generating sigmoidal dose response curves and similar EC50 values. The NLpoly11S/NLpep 114 system displays faster association kinetics and a higher maximum signal.

Example 126

Comparison of FK506 Dose Response Curve and Time Course Generated by FRB-NLpoly11S/FKBP-NLpep114 and Split Firefly Complementation Systems HEK293T cells (800,000) were transfected into wells of 6-well plates with a total of 20 ng pF4A Ag FRB-NLpoly11S and pF4A Ag FKBP-NLpep114 or 750 ng pF4A Ag N-Fluc (1-398)-FRB and FKBP-C-Fluc(394-544) using FuGENE HD at a DNA-to-FuGENE ratio of 1 to 4. pGEM-3Zf(+) DNA was added to bring total DNA in each transfection to 1 µg. Twenty-four hours post transfection, 20,000 cells were re-plated into wells of opaque 96-well assay plates and incubated an additional 24 h. Cells were then treated with 0 or 20 nM rapamycin in phenol red-free OptiMEMI for 3 h.

For FK506 dose response experiments (FIG. 170A), cells were incubated with 0 to 100 pM FK506 inhibitor in phenol red-free OptiMEMI for 5 h, treated with 10 pM furimazine, and then read with GLOMAX Multi in luminescence mode with 0.5 s integration time. For time course experiments (FIG. 170B), cells were treated with 10 pM FK506 in phenol red-free OptiMEMI containing 10 pM furimazine and luminescence was immediately read with GLOMAX Multi.

FIG. 170A-B demonstrates that the NLpoly11S/NLpep 114 and split firefly complementation systems show a dose-dependent decrease in light output following treatment with the FK506 inhibitor. The loss of signal in the NLpoly11S/NLpep 114 system begins at an earlier time point, is more rapid, and is more complete than the split firefly system.

Example 127

Western Blot Showing Expression Levels of FKBP-NLpep114 and FKBP-Fluc(394-544)

HEK293T cells (200.000) were transfected with 0 to 30 ng of pF4Ag NLpep114-FKBP or pF4Ag FKBP-Fluc(394-544) DNA using FugeneHD at a DNA to Fugene ratio of 1 to 8. Forty-eight hours post-transfection, cells were harvested with 1×SDS gel loading buffer. Samples were separated on a 4-10% Tris-HCl SDS-PAGE gel and transferred to PVDF membrane. The membrane was blocked in 5% BSA in TBST for 1 h and then incubated with anti-FKBP (Abcam #ab2918) overnight. Secondary antibody incubation with horse radish peroxidase-conjugated donkey anti-rabbit IgG was performed for 1 h and then the blot was developed using ECL Western Blotting Substrate (Promega Corporation) and the Image Quant LAS 4000 system.

FIG. 171 demonstrates similar expression levels of FKBP-NLpep114 and FKBP-Fluc(394-544) at equal levels of transfected DNA.

Example 128

Dose- and Time-Specific Inhibition of NLpoly11S-BRD4 and Histone H3.3-NLpep114 Interaction by IBET-151

HEK293T cells (20.000) were transfected into wells of a 96-well white assay plate with 10 ng of pF4Ag Histone H3.3-NLpep114 and NLpoly11S-NLpoly11S using Fugene HD at a DNA to Fugene ratio of 1 to 8.

For dose response experiment (FIG. 172A), cells were treated with 0 to 10 pM IBET-151 in phenol red-free OptiMEMI for 4 h at 37° C. and then treated with 10 pM furimazine for 5 min before reading luminescence with GLOMAX Multi.

For time course experiment (FIG. 172B), cells were pre-incubated with 10 pM furimazine for 5 min, treated with 0-500 nM IBET-151 and immediately placed in a GLOMAX Multi for luminescent measurements even 5 min.

FIG. 172A-B demonstrates a dose-dependent decline in luminescence upon treatment with the BRD4 inhibitor IBET-151 that occurs within 3 hours of treatment, consistent with literature reports.

Example 129

RAS/CRAF, BRAF/BRAF, and CRAF/BRAF Dimerization in Response to GDC0879

HEK293T cells (20,000) were co-transfected into wells of 96-well assay plates with combinations of pF4Ag NLpoly11S-BRAF, NLpoly11S-CRAF, NLpep 14-KRAS, or NLpep114-BRAF using a total of 0.1 ng DNA per well and Fugene HD at a ratio of 1 to 4. Twenty-four hours post-transfection, cells were treated with 0 to 10 pM of the BRAF inhibitor GDC0879 in phenol red-free OptiMEMI for 4 h. Furimazine substrate in phenol red-free OptiMEMI was added to 10 pM, and luminescence was read immediately with GLOMAX Multi set to 0.5 s integration time.

FIG. 173 demonstrates a dose dependent increase of RAS/CRAF, BRAF/BRAF and CRAF/BRAF dimerization in response to BRAF inhibitor GDC0879.

Example 130

Twelve synthetic peptides (FIG. 180) were examined for their ability to structurally complement three different versions of NLpoly11S (i.e. 11S, 11S-amino acid 157, 11S-amino acids 156 and 157). Stocks of NLpoly were made to 35 nM in NANOGLO reagent and stocks of NLpep were made to 12.5 nM in PBS pH 7.2. Equal volumes were mixed and samples measured for luminescence on a Tecan Infinite F500 reader (100 msec integration time; 10 min time point) (FIG. 200).

Example 131

Spontaneously Interacting Peptide NLpep86

Purified NLPoly11S was diluted to 40 pM in PBS pH 7+0.01% PRIONEX+1 mM DTT+0.005% Tergitol (affinity buffer). Synthetic NLPeps (NLPep86, WT, 114) were diluted in affinity buffer as follows: NLPep86=60 nM, NLPep114=4.48 mM and NLPepWT=20 uM. 25 uL NLPoly11S and 25 uL an NLPep were mixed and then incubated at ambient temperature for 30 min. 50 ul affinity buffer+20 uM Fz was then added to each mixture, and luminescence measured on a GLOMAX Multi+ using 0.5 s integration. Bmax and Kd values were determined using GraphPad Prism and 1 site specific binding.

FIG. 174 demonstrates 100,000-fold range of affinities using NLPoly11S and various NLPeps. Pep 86 is an example of a spontaneously interacting peptide (with LSP 11S), and Pep 114 is shown for reference as a low affinity interacting peptide.

Example 132

Titration of High Affinity Peptide In Vitro

Purified NLpoly11S (HALOTAG purification/*E. coli* expression; pFN18K) and synthetic peptide NLpep86 (obtained from Peptide 2.0) were titrated at a linear dynamic range using 33 nM NLpoly11S in NANOGLO assay buffer to 3.3 fM-100 nM high affinity NLpep86. For a 30 kDa protein, this corresponds to LOD of 10 fg.

FIG. 176 demonstrates the broad linear range and ability to detect femtamolar concentrations of the high affinity peptide tag (NLpep86). This rivals most sensitive Western Blot (WB)+ Enhanced Chemiluminescence (ECL) kits Example 133

Western Blot-Like Utility of NLpoly and NLpep

A titration of HALOTAG (HT7)-NLpep 80 (80) or NLpep80-HALOTAG (HT7) were run on an SDS page gel. The HALOTAG protein was imaged with HALOTAG-TMR ligand (Promega Corporation) on a Typhoon scanner. The samples were transferred to a membrane and PBS pH 7+0.1% PRIONEX+NLpoly11S (*E. coli* lysate diluted 1:1, 000) was used to blot the membrane. NANOGLO/Fz was then added to the membrane and it was imaged on a ImageQuant.

FIG. 177 demonstrates the sensitivity of detecting proteins tagged with a high affinity NLPep using NLpoly11S. FIG. 177 also compares the detection using NLPep/NLPoly to the detection using fluorescently labeled HALOTAG.

Example 134

Stability of an NLpoly11S Reagent 100 nM NLpoly11S was incubated in NANOGLO assay buffer (Promega Corporation)+100 uM furimazine and assayed with equal amounts of diluted NLpep86. As a control, NANOGLO assay buffer+100 uM furimazine was used to assay an equal volume of diluted NANOLUC luciferase (Promega Corporation).

The results (FIG. 178) demonstrate that an NLpoly11S reagent (containing Fz) has similar stability compared to the commercial NANOGLO assay reagent (also containing Fz).

Example 135

Titration of DNA for High Affinity NLpep78-HT7 Fusion

HEK293 cells (200,000/ml) were reverse transfected with 10-fold dilutions of DNA (starting with 100 ng) from a high affinity peptide, NLpep78, fused to HALOTAG protein (HT7). 100 ul of each transfection was plated in triplicate into wells of a 96-well plate. Twenty-four hours post-transfection, 100 ul NANOGLO assay buffer containing 100 nM NLpoly11S and 100 ul furimazine was added and mixed. Luminescence was measured 10 minutes after reagent addition on a GLOMAX luminometer.

The results (FIG. 179) demonstrate the broad linear range similar to Example 131/FIG. 27. This is essentially a similar experiment to what was done in Example 131 except that this examples uses recombinantly expressed peptide (fused to HALOTAG) in a mammalian cell.

Example 136

Preliminary Results (Array Peptides)

Figure 50:
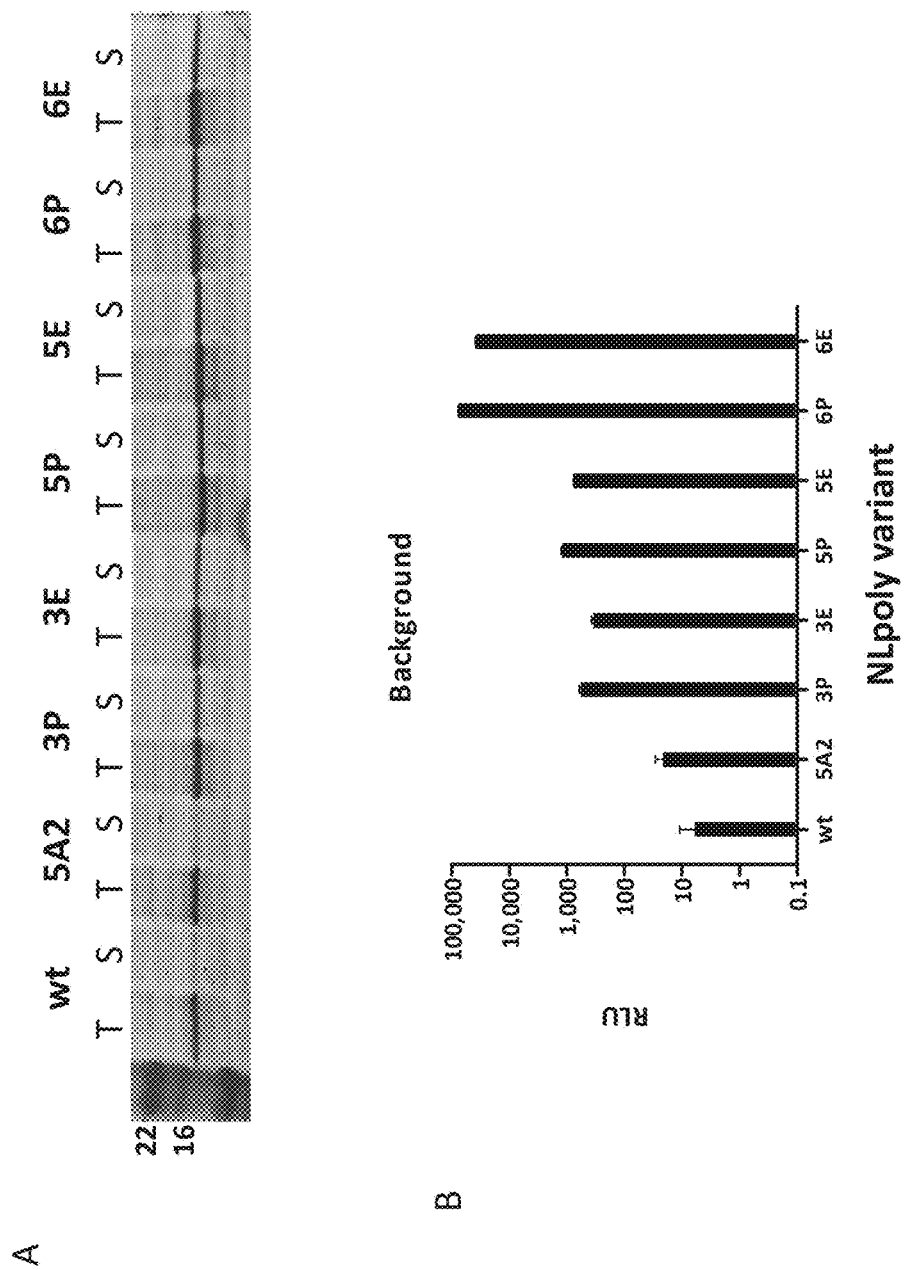
FIG. 50 shows (a) a SDS-PAGE gel of the total lysate and soluble fraction of NLpoly variants and (b) background luminescence of NLpoly variants.
Figure 51:
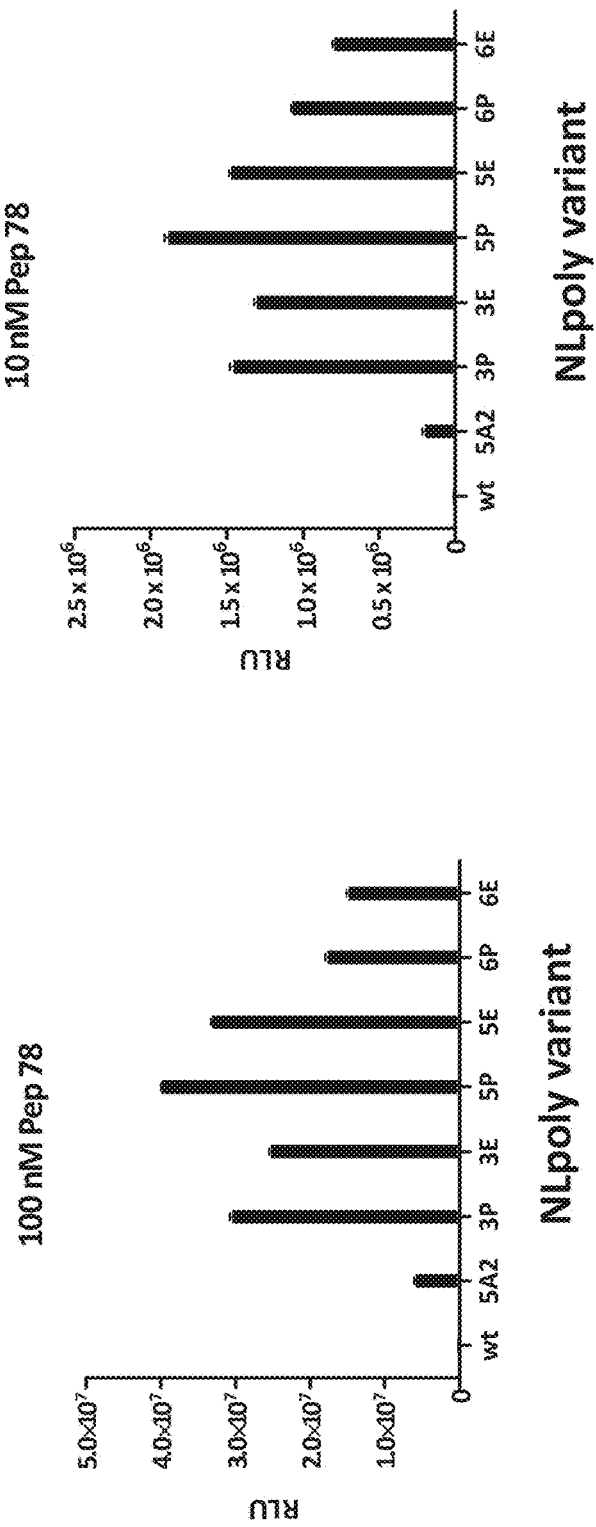
FIG. 51 shows graphs of the luminescence generated with several NLpoly variants when complemented with 10 nm (right) or 100 nM (left) of NLpep78.

In FIG. 183A, 50 nM NLpoly11S was mixed with 7.5 pM NLpep114 and 37.5 pM dark peptide (DP) candidate (Q-162, A-162, K-162 or E-162). NANOGLO assay reagent (Promega Corporation) was added and incubated for 5 minutes. Luminescence was detected. In FIG. 183B, 50 nM NLpoly11S in assay buffer (PBS pH7+0.01% PRIONEX+1 mM DTT+0.005% Tergitol) was mixed with 7.5 pM NLpep114 (also in assay buffer) and variable amounts of dark peptide (DP) candidates Q-162 or K-162 (also in assay buffer). NANOGLO assay reagent (Promega Corporation) was added and incubated for 5 minutes. Luminescence was detected on a Tecan Infinite F500 reader; 100 ms integration time; 5 min time point used.

Panel A indicates that each of the peptide candidates (at 7.5 uM) can inhibit the binding between NLpoly11S and NLpep 114, as indicated by less bioluminescence. Note these "dark" peptides do generate some luminescence, thus the increased signal compared to no peptides at all.

Panel B indicates that with the Lys-162 and Gln-162 peptides the inhibition is dose-dependent.

Example 137

High Purity (>95%) Dark Peptides

Figure 5:
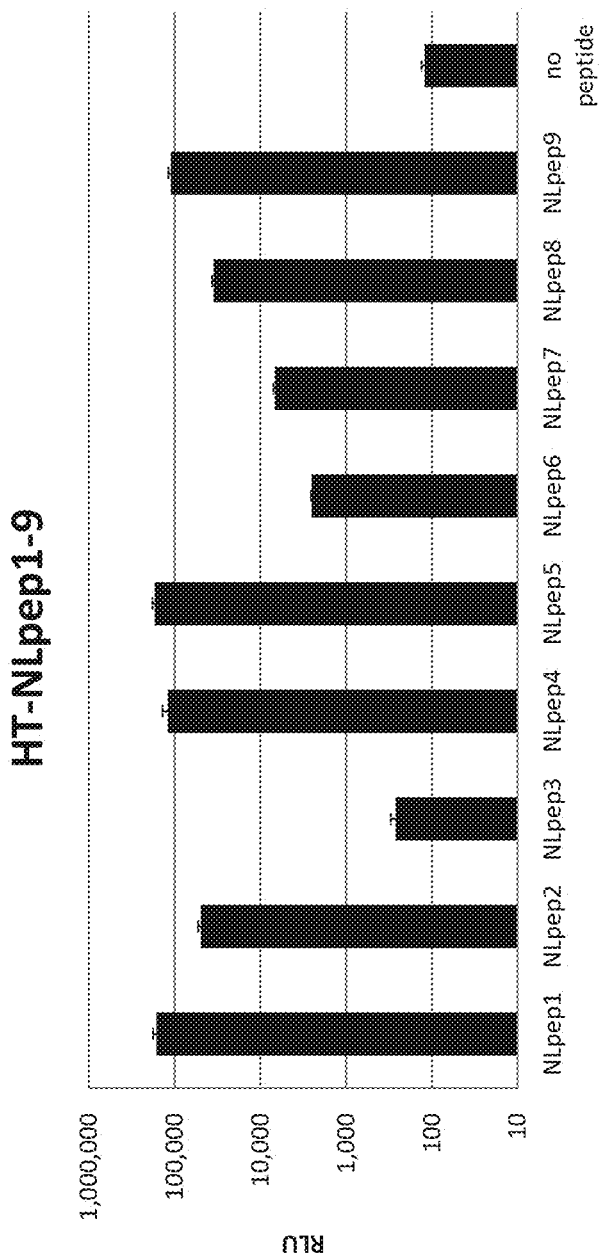
FIG. 5 shows a graph depicting the luminescence (RLUs) detected in HT-NLpeptide fusions.

In FIG. 184A, 5 nM NLpoly11S was mixed with 500 nM NLpep114 and variable amounts of a dark peptide (DP) candidate Q-162 or A-162 (n=3). NANOGLO assay reagent (Promega Corporation) was added and incubated for 5 minutes. Luminescence was detected.

In FIG. 184B, 5 nM NLpoly11S in assay buffer was mixed with variable amounts of dark peptide (DP) candidates Q-162 or A-162 in assay buffer (no NLpep114)(n=3). NANOGLO assay reagent (Promega Corporation) was added and incubated for 5 minutes. Luminescence was detected.

The results (FIGS. 184A and B) substantiate the results from Example 135, but there is greater confidence here because the peptides are more pure. These results also suggest that of the dark peptides variants tested the Ala peptide is the most potent as an inhibitor.

Example 138

Inhibition of Circularly Permuted NANOLUC Luciferase by Dark Peptides

To determine whether "high affinity/low activity" NLpeps (a.k.a. Dark Peptides) can compete with the intramolecular interaction (i.e., protein folding) between NANOLUC luciferase (Nluc) residues 1-156 and 157-169 in the context of circularly permuted Nluc (CP Nluc).

CP NLuc: NLuc 157-169—33aa-linker—Nluc 1-156

Dark peptides: VTGWRLCERIL (SEQ ID NO: 2366) (wt)

1. Gln-162 VSGWQLFKKIS (SEQ ID NO: 2388)

2. Ala-162 VSGWALFKKIS (SEQ ID NO: 2390)

Recombinant CP Nluc was prepared as a soluble fraction of an *E. coli* 5×-concentrated lysate (T7-promoter; overnight expression). A 10,000-fold dilution of the CP Nluc in Assay Buffer (PBS pH 7/0.01% PRIONEX/1 mM DTT/0.005% Tergitol) was used. Synthetically-derived dark peptides were prepared across a range of concentrations, also in the Assay Buffer. Reactions were set up using 30 μL of CP NLuc and 60 μL of Dark peptide and assayed by adding 90 μL NANOGLO assay reagent (Promega Corporation). Luminescence was measured (5 min) on a Tecan Infinite F500 reader (100 ms integration). Three replicates were used for Dark peptide samples. Two replicates were used for buffer controls (acetic acid from peptide stocks).

FIG. 185 demonstrates a dose-response of the dark peptides with CP Nluc. FIG. 186 demonstrates a time course of dark peptide (56 pM peptide) with CP Nluc.

The results indicate that both dark peptides, particularly the Ala162 version, are able to significantly inhibit generation of luminescence by CP Nluc (Ala162 >2 logs: Gln162 >1 log). This indicates that a CP Nluc approach has utility for inverse complementation.

Example 139

Dark Peptides in Cells

In this example, the following constructs were used:
Four dark peptide vectors: pF4Ag+FKBP-dark peptide Ala-162, Leu-162, Gln-162 and Val-162
Two non-dark peptide vectors: pFc5K2 FKBP-NLpep114 (low affinity peptide) and pFc5K2 FKBP-NLpep80 (high affinity peptide)
One NLpoly vector: pFc5K2 FRB-NLpoly11S
All constructs harbored a CMV promoter for mammalian cell expression. All fusions constructs contained a 10aa Gly-Ser flexible linker.

Serial dilutions of the dark peptide constructs, Ala-162 (A), Leu-162 (L), Gln-162 (Q) and Val-162 (V), were made in OptiMem and additionally contained carrier DNA (pGEM-3Z).

For transfection containing NLpoly11S only, 20 ul of diluted dark peptide was mixed with 20 ul NLpoly11S, 60 ul OptiMem and 8 uL Fugene. For transfections containing NLpoly11S and NLpep 114 or NLpep80, 20 ul of diluted dark peptide was mixed with 20 ul NLpoly11S (10 ng/ul), 20 ul NLpep 114 or NLpep80 (10 ng/ul), 40 ul OptiMem and 8 ul Fugene. All were incubated at RT for 15 minutes. 5 ul of each transfection, in triplicate, was added to wells of two, 96-well plates (one+Rapamycin one without Rapamycin). 100 ul of HEK293T at 200,000 cells/ml in DMEM+10% FBS were then added to the wells, and the transfected cells incubated overnight at 37° C.

The medium was then removed from the cells, and the cells washed with 200 µl DPBS. 50 µl of 50 nM rapamycin was added, and the cells incubated for 1 h at 37° C. 20 µl of 5 mM furimazine in 5 ml phenol red-free OptiMEMI+50 nM rapamycin was diluted, 50l added directly to the cells and incubated for 5 min in GLOMAX Multi+. Luminescence was measured on the GLOMAX FIG. 187 demonstrates that the dark peptides, when fused to FKBP, can reduce the background signal of NLpoly11S (i.e., FRB-NLpoly11S). Taken together FIGS. 188-190 demonstrate that the dark peptides, when fused to FKBP, can 1) compete with the folding of full length NANOLUC (i.e., FRB-NANOLUC or NANOLUC-FRB) and 2) compete with both low and high affinity peptides (also FKBP fusions) for binding to NLpoly11S (i.e. FRB-NLpoly11S), and as a result reduce the total luminescence being produced and detected in live cells.

Example 140

Virology Applications

In addition to enabling measurement of viral titers, spontaneously interacting NLpeps also enable studying re-assortment of viruses (e.g., influenza). Re-assortment of viruses refers to the formation of new "hybrid" viruses from dual infections e.g. H1N1, H5N1, H3N2 (H is hemagglutinin; N is neuraminidase); bird, human, pig, chicken (most common in pigs)

Because of its segmented nature, the influenza genome can be readily shuffled in host cells infected with more than one virus. When a cell is infected with influenza viruses from different species, reassortment can result in progeny viruses that contain genes from strains that normally infect birds and genes from strains that normally infect humans, leading to the creation of new strains that have never been seen in most hosts. Moreover, because at least 16 different subtypes and nine different neuraminidase subtypes have been characterized, many different combinations of capsid proteins are possible. Of these subtypes, three subtypes of hemagglutinin (H1, H2, and H3) and two subtypes of neuraminidase (N1 and N2) have caused sustained epidemics in the human population. Birds are hosts for all influenza A subtypes and are the reservoir from which new HA subtypes are introduced into humans (Palese, 2004).

The application of the present system for detecting re-assortment is that the two components of spontaneously interacting NLpeps are be put into different viral particles, or the large component in cells and the small component in a virus, and the presence of both elements (e.g., being present in a cell) is detected by luminescence.

Example 141

Validating the Use of Spontaneously Interacting NLpep86 as an Epitope Tag for Proteins Degraded by the Proteasome Experiments were conducted during development of embodiments of the present invention to validate the use of NLpep86 as a tag to monitor expression levels of proteins degraded by the proteasome. To do this, Nlpep86 was fused to firefly luciferase variants that were also fused to either one or more PEST, CL1 or ubiquitin sequences (pBC21, 22, 24-29). Each of these constructs is expected to undergo proteasome-mediated turnover to varying degrees following expression from a mutant CMV promoter (d1CMV).

The constructs pBC21.22, 24-29 and control constructs expressing untagged firefly luciferase or untagged firefly luciferase fused to a PEST sequence (ATG082 and ATG083) were transiently transfected into HELA cells plated at 10,000 cells per well in a 96-well plate using 100 µL of DMEM+10% FBS. The following day, 10 µL of a transfection mixture (920 ul OptiMEM I+5 ug of the respective construct+15 ul Fugene HD) was added per well and cells were allowed to incubate for 48 hours in a 37° C. incubator containing 5% CO2. Protein expression levels were quantified in replicate wells for each construct by detecting firefly luciferase activity or by adding a detection reagent containing NLpoly11S (purified NLpoly11S added to NANOGLO). A good correlation was observed between the NLpep86 and Fluc signals in each case, suggesting that NLpep86 detection can be used to monitor fusion protein expression levels for proteins degraded by the proteasome.

```
BC21 (SEQ ID NO: 172) MVSGWRLFKKIS-GGSGGGGSGG-Fluc
(SEQ ID NO: 2581)(high affinity)

BC22 (SEQ ID NO: 172) MVSGWRLFKKIS-GGSGGGGSGG-
FlucP (SEQ ID NO: 2581) (high affinity)

BC24 (SEQ ID NO: 172) pFC15A/MVSGWRLFKKIS-GGSGGGG
SGG-Fluc-CL1 (SEQ ID NO: 2581)

BC25 (SEQ ID NO: 172) MVSGWRLFKKIS-GGSGGGGSGG-
Fluc-PEST12opt (SEQ ID NO: 2581) (high affinity)

BC26 (SEQ ID NO: 172) MVSGWRLFKKIS-GGSGGGGSGG-
Fluc-CP (SEQ ID NO: 2581) (high affinity)

BC27 UBQ G76V-VGKLGRQDP(SEQ ID NO: 2583)-
Fluc(EDAKNIKK..(SEQ ID NO: 2582))-GGSGGGGSGG
(SEQ ID NO: 2581)-VSGWRLFKKIS (SEQ IN NO:
390)(high affinity)
```

-continued

BC28 UBQ-RGKLGRQDP(SEQ ID NO: 2584)-Fluc(EDAKN
IKK.. (SEQ IDNO: 2582))-GGSGGGGSGG(SEQ ID
NO: 2581)-VSGWRLFKKIS (SEQ INNO: 390)((high
affinity)

BC29 UBQ-LGKLGRQDP(SEQ ID NO: 2585)-Fluc (EDAKNI
KK.. (SEQ ID NO: 2582))-GGSGGGGSGG(SEQ ID NO:
2581)-VSGWRLFKKIS (high affinity)

ATG083 D1 FlucP; pF4Ag CMV Luc2-PEST

ATG082 D1Fluc; pF4Ag CMV Luc2

After a 48 hour incubation, 100 uL NANOGLO NLpep11S reagent (90 ul of NLpoly11S in 50 ml of NANOGLO assay reagent was added to each well and incubate for 3 minutes with shaking. Luminescence was then read on GLOMAX luminometer (0.5 sec/well).

The results in FIG. 191 demonstrate that the signal from Fluc and NLpep86 appear to reflect each other with respect to relative brightness and have similar RLUs. BC21, BC25 and BC29 are the brightest constructs of the BC series with BC21 appearing the brightest in this experiment BC24, 26 and 27 are the least bright which is predicted from the engineered destabilization.

Example 142

This example demonstrates that a known complementing peptide can be used as a linker between the same or a different complementing NLpep and NLpoly11S (e.g., NLpep78(2×)).

HEK293T cells (20.000) were transfection with a mixture containing 20 µL of NLpep78-HALOTAG (HT) or NLpep78 (2×)-HT DNA, 80 µL of phenol-free Opimex and 8 µL of FugeneHD. Cells were grown overnight at 37° C. and assayed at 24 h using NANOGLO assay reagent (Promega Corporation) containing 33 nM purified NLpoly11S.

The results (FIG. 192) demonstrate that a tandem binding peptide can be used and that it may suffice as a linker.

Example 143

Comparison of the Specific Activities of Wild-Type Oplophorus Luciferase Residues 1-156, NLpoly11S and NANOLUC in HEK293T Lysates Each clone was inserted into pFN21A HALOTAG CMV FLEXI Vector (Promega G2821), and lysates were prepared as follows: 3 ml HEK293T cells that have been diluted to a concentration of 200,000 cells/ml (600,000 cells total) were plated into each well of a 6-well plate and grown overnight at 37° C. in a $CO_2$ incubator. The following day transfection complexes of each DNA were prepared by combining 6.6 µg of DNA. Opti-MEM (Life Technologies 11058-021) to a final volume of 310 µl and 20 µl of FUGENEHD (Promega E231a). The transfection complexes were incubated for 20 minutes and then 150 µl of each complex added in duplicate to cells. The cells were grown overnight 37° C. in a $CO_2$ incubator. The following day, the cells were washed cells with DPBS (Life Technologies 14190-144), and 1 ml fresh DPBS added. Cells were frozen to lyse and then thawed for testing. Duplicate transfection reactions lysates were combined.

To quantitate the level of protein expression for each sample, each sample was labeled with HALOTAG TMR Ligand (Promega Corporation) as follows: HALOTAG TMR Ligand (Promega G8251) was diluted 1:100 into water to a concentration of 0.05 mM; 100 µl of each lysate was mixed with 2 µl of diluted TMR ligand and incubated for 30 minutes at RT; 20 µl of SDS loading dye was added, and the samples heated to 95° C. for 5 minutes. 10l and 20 µl of each sample was loaded onto a polyacrylamide gel (Bio-Rad, 4-15% Criterion™ Tris-HCl Gel #345-0030), run at 200V for 1 hour and then quantitated using ImageQuant™ LAS 400) (GE). Both NLpoly11S and NANOLUC luciferase (Nluc) expressed approximately 4-fold higher than 1-156.

In order to compare the specific activities of Nluc (full length enzyme) to wt Oplophorus 1-156 and NLpoly11S in combination with wt Oplophorus 157-169 peptide (binary proteins), substrate titrations were run for all of the samples, but for the binary samples substrate titrations were run at multiple peptide concentrations. Using this format, it was possible to calculate a Vmax value for Nluc and both Vmax and Bmax values for NLpoly11S and wt Oplophorus 1-156. Three separate experiments were run using this format and Vmax and Bmax values were normalized to the Vmax of NANOLUC. Relative specific activities (calculated as averages of Vmax and Bmax) are normalized to N NANOLUC.

| Sample | Relative specific activity (* with wt 157-169 peptide) |
|---|---|
| NanoLuc | 1.00 |
| wt 1-156 | 0.07* |
| 11S | 0.18* |

Example 144

Effect of NLpoly and NLpep on Intracellular Half-Life of FlucP

To determine if appending either NLpoly11S or NLpep114 to Luc2-PEST alters the intracellular half-live as measured by decay of signal after cycloheximide (CHX) treatment.

Day 1: Plate Hela cells in 6 well plates. Plate 3 ml of cells (200,000/ml) into two 6 well plates. Grow overnight. DMEM+10% FBS.

Constructs containing FlucP, wt 157-169 FlucP, NLpoly11S, NLpep114 FlucP and pBC22 (all pF4Ag D1-CMV) were transfected into HeLa cells. Briefly, 33 ul of DNA (3.3 ug) was added to 122 ul of OptiMem, mixed and 9.9 ul of FUGENEHD added. The transfection mixtures were then incubated at RT for 20 minutes, and 150 ul added to cells. After an overnight incubation, cells were replated at 10,000 cells/well and incubated again overnight.

After incubation, the growth media was removed and replaced with either 0.4 mM cycloheximide (CHX) or control (DMSO). At each time point, ONE-Glo™ assay reagent was added, incubated at RT for 3 minutes and luminescence measured on Tecan GENios Pro luminometer.

FIG. 193 demonstrates that none of the NLpoly or NLpep components tested interfere with the normal intracellular degradation of a reporter enzyme (FlucP).

Example 145

Extracellular Protease Activity Assay

In some embodiments, the present invention provides an assay for extracellular protease (e.g. caspase) activity. A quenched peptide is provided (e.g., high affinity peptide such as NLpep86) that can only be accessed and refolded into an active luciferase with an NLpoly, e.g., NLpoly11S, upon removal of the quencher moiety by a protease (e.g. caspase) FIG. 194). NLpoly11S and furimazine are introduced to the assay as a reagent and then samples are measured for bioluminescence.

Example 146

Medially Attached Pro-Groups (Isopeptides and Glycosylated Amino Acids)

Assays are provided for measuring the activity of an enzyme through using a ProNLpep. This configuration of ProNLpep is a NLpep with one of the internal amino acids conjugated to a group that prevents the complementation of the peptide to an NLpoly. When this ProNLpep encounters an enzyme that removes the blocking group (e.g., caspase 1 in the case of WEHD or a glycosidase in the case of the serine glycoside), the ability of the NLpep to complement to an NLpoly is restored (FIG. 195). In the presence of furimazine, this results in production of light in proportion to the activity of the enzyme of interest. Because each enzymatic cleavage results in the formation of a luciferase, the sensitivity of this system for assaying small concentrations of enzyme is expected to be high.

Example 147

Linker Evaluation

Assays are provided measuring the release of cargo from an antibody. An NLpep is attached to an antibody, protein, peptide, or transporter recognition moiety in such a manner that prevents it from associating with a NLpoly to form a luciferase. Upon a stimulus, such as cellular internalization, the linker between the antibody, protein, peptide, or transporter recognition moiety and the NLpep is cleaved, due to intracellular reducing potential, and the NLpep is released (FIG. 196). The NLpep can now complement with an NLpoly to form a luciferase, and the light generated will be proportional to the cleavage of the linker. This provides a system to measure the release of a compound from an antibody, which is a surrogate for cytotoxic drug delivery from Antibody Drug Conjugates. The linker can be cleaved through any manner known in the art, such as through intracellular proteases or pH sensitivity. Again, because a luciferase is generated through every cleavage, this is expected to be a sensitive method for assaying cleavage.

Example 148

The use of antibodies to target and destroy diseased cells has shown significant therapeutical promise and occurs through a process called Antibody-dependent cell-mediated cytotoxicity (ADCC). There are many ways to monitor ADCC activity, including crosslinking of different cells types or monitoring gene transcription using specific luciferase reporters expressed in the effector cells. A potential alternative readout to the ADCC mechanism of action could be in the monitoring of specific protein:protein interactions induced or disrupted after the binding of therapeutical antibodies to their target antigens or receptors presented on the cell surface. In some embodiments, the specific protein:protein interactions are monitored using the system of the present invention, which provides a readout in the time frame of minutes versus hours which is required by other methods.

Example 149

Immunoassays

Embodiments of the present invention find use in homogeneous immunoassays, for example, as depicted in FIG. 201, where the NLpep and NLpoly are fused to binding moieties (e.g., A and B). The binding moieties A and B may comprise many different components, making up several different formats of immunoassays than can be utilized as target specific assays or more generalized reagents to be used in immunoassays. The binding moieties will only come into close proximity in the presence of the target, thus bringing the NLpep and NLpoly into close proximity resulting in production of luminescence upon substrate addition. Table 7 lists exemplary of binding moieties (Mie et al. The Analyst. 2012 Mar. 7; 137(5): 1085-9;

Stains et al. ACS chemical biology, 2010 Oct. 15; 5(10): 943-52; Ueda et al. Journal of immunological methods. 2003 August; 279(1-2):209-18. Ueda et al. Nature biotechnology, 1996 December; 14(13):1714-8; Lim et al. Analytical chemistry, 2007 Aug. 15; 79(16):6193-200; Komiya et al. Analytical biochemistry. 2004 Apr. 15; 327(2):241-6; Shirasu et al. Analytical sciences: the international journal of the Japan Society for Analytical Chemistry. 2009 September; 25(9): 1095-100; herein incorporated by reference in their entireties).

TABLE 7

| (A) binding moiety | (B) Binding moiety | Example from literature | Reference |
|---|---|---|---|
| Domain of Protein A | Domain of Protein A | Rluc fragments fused to B-domain of protein A to detect E. coli with primary anti-coli Ab + fusion complexed rabbit anti-mouse IgG | Mie et al, Analyst, 2012 |
| Protein A | Protein A | | |
| Protein G | Protein G | | |
| Domain of protein G | Domain of protein G | | |
| Polyclonal Ab | Polyclonal Ab: either same or second pAB recognizing same target | | |
| mAb | mAb to same target recognizing different epitope | | |
| scFv | scFv from an antibody recognizing different epitope on same | Omnitarg and Herceptin Fluc fusions for HER2 detection; b- | Stains et al, ACS Chem Biol, 2010; Komiya et al, Analytical |

TABLE 7-continued

| (A) binding moiety | (B) Binding moiety | Example from literature | Reference |
|---|---|---|---|
| | target | gal fusions human serum albumin antibodies | Biochemistry, 2004 |
| Receptor domain 1 | Receptor domain 2 to same target | Flt-1 domain 1 and 2 Fluc fusions for VEGF detection | Stains et al, ACS Chem Biol, 2010 |
| Ab variable heavy chain | Ab variable light chain of same antibody | b-gal chain fusions for HEL; alkaline phosphatase and thioredoxine fusions for benzaldehyde | Ueda et al, J of Immunological Methids, 2003; Shirasu et al, Analytical Sciences, 2009 |
| Mix and match: pAb, mAb, scFv, receptor domain, Vh, Vl | Mix and match: pAb, mAb, scFv, receptor domain, Vh, Vl | CD4 receptor domain and scFv of anti-gp120 antibody Fluc fusions for HIV detection; | Stains et al, ACS Chem Biol, 2010 |

In some embodiments in which the binding moieties are comprised of protein A, protein G, or domains of protein A or G, the immunoassay system utilizes the NLpoly and NLpep fusions to complex with antibodies prior to addition with the sample containing the target. Antibodies bind non-covalently to protein A and G naturally. Introduction of a covalent coupling between the antibody and the fusions are introduced in the complex formation step. The NLpep/NLpoly-protein A/G/domain fusions binding moieties can be complexed to the antibodies in various formats, for example:
   individually with two different specific antibodies targeting two different proteins to determine if proteins exist in complex;
   together with a single target specific polyclonal antibody;
   together with secondary antibody (e.g., rabbit anti mouse IgG) to bind to sample preincubated with primary antibody (e.g., target specific mouse IgG); and
   individually with two antibodies targeting two different epitopes on the same target protein.

As described in Table 7, in some embodiments, the binding moieties are target specific antibodies, domains of target specific antibodies, receptor domains that bind target ligands, or a combination of antibodies, antibody domains, and target receptor domains.

In some embodiments, targets are monitored in samples which include but are not limited to blood, plasma, urine, serum, cell lysates, cells (primary or cell lines), cell culture supernatant, cerebral spinal fluid, bronchial alveolar lavage, tissue biopsy samples, chemical compounds, etc.

Methods describe analysis of targets which include but are not limited to: proteins, small molecules and compounds, haptens, peptides, hormones, heterodimeric protein-protein interactions, cell surface antigens, interactions between receptors and ligands, proteins in complex, viruses and viral components, bacteria, toxins, synthetic and natural drugs, steroids, catecholamines, eicosanoids, protein phosphorylation events, etc.

Applications include but are not limited to detection or quantitation of target for clinical disease monitoring, diagnostics, therapeutic drug monitoring, biological research, pharmaceuticals, compound detection and monitoring in the food/beverage/fragrance industry, viral clade identification, etc.

Additional applications include high throughput screening of molecules capable of disrupting the interactions of target with its receptor thus resulting in a loss of signal assay. There are several proposed formats for use of NLpep/NLpoly in immunoassays. In some embodiments, these are performed homogeneously and supplied as a kit, as separate diagnostic and research kit components, or as stand-alone reagents customizable to the individual's assay.

In other embodiments, homogeneous immunoassay utilizing NLpep/NLpolyutilize variations of the HitHunter or CEDIA technology (Yang et al. Analytical biochemistry. 2005 Jan. 1; 336(1):102-7; Golla and Seethala. Journal of biomolecular screening. 2002 December; 7(6):515-25; herein incorporated by reference in their entireties). In such assays, components include: target specific antibody, NLpoly, NLpep-recombinant target fusion, and substrate. The NLpoly and NLpep-recombinant target fusion form a luminescent complex when the NLpep is not bound to the target specific antibody. Upon addition of the test sample to the assay components, the amount of luminescence is directly proportional to the target concentration in the test sample as the target present in the test sample will compete with the NLpep-recombinant target fusion on the antibody (e.g., gain of signal indicates the presence of the target).

Example 150

Exemplary Configurations for NLpoly11S in Spontaneous Complementation

Various configurations of NLpoly11S may find use in spontaneous complementation assays or systems. Such configurations may include: deletions at the C-term (e.g., to reduce background luminescence), N- and/or C-terminal appendages (e.g., based on whether they are to be purified by His or HALOTAG), etc. For example, the appendage left by HALOTAG when it's a N-terminal tag is SDNIAI. Exemplary configurations include: SDNAIA-11S (HALOTAG purification); SDN-11S; SDNAIA-11S, with single del at C-term SDN-11S, with single del at C-term; SDNAIA-11S, with double del at C-term; SDN-11S, with double del at C-term; SDNAIA-11S, with triple del at C-term; SDN-11S, with triple del at C-term; 6His-AIA-11 S; 6His-11S; 6His-AIA-11S with single del at C-term 6His-11S with single del at C-term; 6His-AIA-11S with double del at C-term; 6His-11S with double del at C-term; 6His-AIA-11S with triple del at C-term; 6His-11S with triple del at C-term: 11S-6His; 11S-6His, minus C-term 11S residue; 11S-6His, minus last two C-term 11S residues; 11S-6His, minus last three C-term 11S residues; 11S-HT7, minus C-term 11 S residue; 11S-HT7, minus last two C-term 11S residues: 1 S-HT7, minus last three C-term 11S residues: 6His-HT7-AIA-11S: 6His-HT7-11S; 6His-AIA-HT7-11S (with single, double, triple 11S C-term dels); 6His-HT7-11S (with single, double, triple 11S C-term dels); 11S-HT7-6His; 11S-HT7-6His (with single, double, triple 11S C-term dels); and Ternary 11 S.

Example 151

Protein Interactions for Binary Complementation Studies

The binary complementation system described herein has been used to analyze a wide variety of protein interactions (See Table 8).

TABLE 8

Protein Interactions for Binary Complementation Studies

| Interaction | Status |
|---|---|
| FRB/FKBP | Tested |
| V2R/ARRB2 | Tested |
| V2R Homodimerization | Tested |
| BRD4/H3.3 | Tested |
| L3MBTL3/BCLAF1 | Tested |
| GR Homodimerization | Tested |
| RAS/RAF | Tested |
| p53/MDM2 | Tested |
| EGFR/GRB2 | Tested |
| BCL2/BIM/BAX | Tested |
| MYC/MAX | Tested |
| CUL1/NEDD8 | In Progress |
| EZH2/SUZ12/EED | In Progress |
| GABAA Multimerization | In Progress |

Example 152

Dissociation Constants and Bmax Values for NLpolys with 108 Variants of NLpeps (Array#2)

NLpeps were synthesized in array format by New England Peptide (peptides blocked at N-terminus by acetylation and at C-terminus by amidation; peptides in arrays were synthesized at ~2 mg scale) (Table 9). Each peptide was lyophilized in 2 separate plates. Each well from 1 of the plates of peptides was dissolved in 100 uL nanopure water, and the A260 measured and used to calculate the concentration using the extinction coefficient of each peptide. The concentration was then adjusted based on the purity of the peptide, and nanopure water was added to give a final concentration of 800 uM.

TABLE 9

Peptide array 2 sequences

| | Sequence | SEQ ID NO. |
|---|---|---|
| array2.1 | VTGYRLFKKIS | 2462 |
| array2.2 | VTGYRLFKKAS | 2463 |
| array2.3 | VTGYRLFKKES | 2464 |
| array2.4 | VTGYRLFKQIS | 2465 |
| array2.5 | VTGYRLFKQAS | 2466 |
| array2.6 | VTGYRLFKQES | 2467 |
| array2.7 | VTGYRLFKEIS | 2468 |
| array2.8 | VTGYRLFKEAS | 2469 |
| array2.9 | VTGYRLFKEES | 2470 |
| array2.10 | VTGYRLFQKIS | 2471 |
| array2.11 | VTGYRLFQKAS | 2472 |
| array2.12 | VTGYRLFQKES | 2473 |
| array2.13 | VTGYRLFQQIS | 2474 |
| array2.14 | VTGYRLFQQAS | 2475 |
| array2.15 | VTGYRLFQQES | 2476 |
| array2.16 | VTGYRLFQEIS | 2477 |
| array2.17 | VTGYRLFQEAS | 2478 |
| array2.18 | VTGYRLFQEES | 2479 |
| array2.19 | VTGYRLFEKIS | 2480 |
| array2.20 | VTGYRLFEKAS | 2481 |
| array2.21 | VTGYRLFEKES | 2482 |
| array2.22 | VTGYRLFEQIS | 2483 |
| array2.23 | VTGYRLFEQAS | 2484 |
| array2.24 | VTGYRLFEQES | 2485 |
| array2.25 | VTGYRLFEEIS | 2486 |
| array2.26 | VTGYRLFEEAS | 2487 |
| array2.27 | VTGYRLFEEES | 2488 |
| array2.28 | VTGYRLFKKIL | 2489 |
| array2.29 | VTGYRLFKKAL | 2490 |
| array2.30 | VTGYRLFKKEL | 2491 |
| array2.31 | VTGYRLFKQIL | 2492 |
| array2.32 | VTGYRLFKQAL | 2493 |
| array2.33 | VTGYRLFKQEL | 2494 |
| array2.34 | VTGYRLFKEIL | 2495 |
| array2.35 | VTGYRLFKEAL | 2496 |
| array2.36 | VTGYRLFKEEL | 2497 |
| array2.37 | VTGYRLFQKIL | 2498 |
| array2.38 | VTGYRLFQKAL | 2499 |
| array2.39 | VTGYRLFQKEL | 2500 |
| array2.40 | VTGYRLFQQIL | 2501 |
| array2.41 | VTGYRLFQQAL | 2502 |
| array2.42 | VTGYRLFQQEL | 2503 |
| array2.43 | VTGYRLFQEIL | 2504 |
| array2.44 | VTGYRLFQEAL | 2505 |
| array2.45 | VTGYRLFQEEL | 2506 |
| array2.46 | VTGYRLFEKIL | 2507 |
| array2.47 | VTGYRLFEKAL | 2508 |
| array2.48 | VTGYRLFEKEL | 2509 |
| array2.49 | VTGYRLFEQIL | 2510 |
| array2.50 | VTGYRLFEQAL | 2511 |
| array2.51 | VTGYRLFEQEL | 2512 |

TABLE 9-continued

Peptide array 2 sequences

|  | Sequence | SEQ ID NO. |
|---|---|---|
| array2.52 | VTGYRLFEEIL | 2513 |
| array2.53 | VTGYRLFEEAL | 2514 |
| array2.54 | VTGYRLFEEEL | 2515 |
| array2.55 | VEGYRLFKKIS | 2516 |
| array2.56 | VEGYRLFKKAS | 2517 |
| array2.57 | VEGYRLFKKES | 2518 |
| array2.58 | VEGYRLFKQIS | 2519 |
| array2.59 | VEGYRLFKQAS | 2520 |
| array2.60 | VEGYRLFKQES | 2521 |
| array2.61 | VEGYRLFKEIS | 2522 |
| array2.62 | VEGYRLFKEAS | 2523 |
| array2.63 | VEGYRLFKEES | 2524 |
| array2.64 | VEGYRLFQKIS | 2525 |
| array2.65 | VEGYRLFQKAS | 2526 |
| array2.66 | VEGYRLFQKES | 2527 |
| array2.67 | VEGYRLFQQIS | 2528 |
| array2.68 | VEGYRLFQQAS | 2529 |
| array2.69 | VEGYRLFQQES | 2530 |
| array2.70 | VEGYRLFQEIS | 2531 |
| array2.71 | VEGYRLFQEAS | 2532 |
| array2.72 | VEGYRLFQEES | 2533 |
| array2.73 | VEGYRLFEKIS | 2534 |
| array2.74 | VEGYRLFEKAS | 2535 |
| array2.75 | VEGYRLFEKES | 2536 |
| array2.76 | VEGYRLFEQIS | 2537 |
| array2.77 | VEGYRLFEQAS | 2538 |
| array2.78 | VEGYRLFEQES | 2539 |
| array2.79 | VEGYRLFEEIS | 2540 |
| array2.80 | VEGYRLFEEAS | 2541 |
| array2.81 | VEGYRLFEEES | 2542 |
| array2.82 | VEGYRLFKKIL | 2543 |
| array2.83 | VEGYRLFKKAL | 2544 |
| array2.84 | VEGYRLFKKEL | 2545 |
| array2.85 | VEGYRLFKQIL | 2546 |
| array2.86 | VEGYRLFKQAL | 2547 |
| array2.87 | VEGYRLFKQEL | 2548 |
| array2.88 | VEGYRLFKEIL | 2549 |
| array2.89 | VEGYRLFKEAL | 2550 |
| array2.90 | VEGYRLFKEEL | 2551 |
| array2.91 | VEGYRLFQKIL | 2552 |
| array2.92 | VEGYRLFQKAL | 2553 |
| array2.93 | VEGYRLFQKEL | 2554 |
| array2.94 | VEGYRLFQQIL | 2555 |
| array2.95 | VEGYRLFQQAL | 2556 |
| array2.96 | VEGYRLFQQEL | 2557 |
| array2.97 | VEGYRLFQEIL | 2558 |
| array2.98 | VEGYRLFQEAL | 2559 |
| array2.99 | VEGYRLFQEEL | 2560 |
| array2.100 | VEGYRLFEKIL | 2561 |
| array2.101 | VEGYRLFEKAL | 2562 |
| array2.102 | VEGYRLFEKEL | 2563 |
| array2.103 | VEGYRLFEQIL | 2564 |
| array2.104 | VEGYRLFEQAL | 2565 |
| array2.105 | VEGYRLFEQEL | 2566 |
| array2.106 | VEGYRLFEEIL | 2567 |
| array2.107 | VEGYRLFEEAL | 2568 |
| array2.108 | VEGYRLFEEEL | 2569 |

Peptides were diluted to 400 uM (4×) in PBS+0.1% PRIONEX and then diluted serially 7 times (8 concentrations total) in 0.5 log steps (3.162 fold dilution). NLpoly11S was diluted 1:10^6 into PBS+0.1% PRIONEX. 25 uL each NLpep+25 uL NLpoly11S were mixed and incubated for 30 min at RT. 50 uL NANOGLO+100 uM Fz was added and incubated for 30 min at RT. Luminescence was measured on a GLOMAX Multi+ with 0.5 sec integration. Kd/Bmax were determined using Graphpad Prism, One site-specific binding, best-fit values. Table 10 indicates the dissociation constant and Bmax values for NLpoly11S and the indicated NLPep. The results indicate the affects of mutations on the binding to NLpoly11S and the ability of the complex to produce luminescence.

TABLE 10

|  | SEQ ID NO: | Peptide Sequence | Bmax | Kd | Bmax | Kd |
|---|---|---|---|---|---|---|
| array2.1 | 2462 | VTGYRLFKKIS | 134567 | 0.01334 | 4936 | 0.003695 |
| array2.2 | 2463 | VTGYRLFKKAS | 103904 | 0.2411 | 711.8 | 0.006084 |

TABLE 10-continued

| | SEQ ID NO: | Peptide Sequence | Bmax | Kd | Bmax | Kd |
|---|---|---|---|---|---|---|
| array2.3 | 2464 | VTGYRLFKKES | 55963 | 0.773 | 1705 | 0.06499 |
| array2.4 | 2465 | VTGYRLFKQIS | 104275 | 0.7462 | 4670 | 0.09318 |
| array2.5 | 2466 | VTGYRLFKQAS | 31031 | 1.953 | 436.4 | 0.05649 |
| array2.6 | 2467 | VTGYRLFKQES | 5006 | 1.348 | 182 | 0.1583 |
| array2.7 | 2468 | VTGYRLFKEIS | 32026 | 4.438 | 1173 | 0.5196 |
| array2.8 | 2469 | VTGYRLFKEAS | 3929 | 2.568 | 200.6 | 0.3566 |
| array2.9 | 2470 | VTGYRLFKEES | 1453 | 3.863 | 118.6 | 1.044 |
| array2.10 | 2471 | VTGYRLFQKIS | 112540 | 0.08118 | 4037 | 0.01352 |
| array2.11 | 2472 | VTGYRLFQKAS | 80943 | 0.7485 | 4035 | 0.1039 |
| array2.12 | 2473 | VTGYRLFQKES | 17237 | 0.4173 | 3190 | 0.3233 |
| array2.13 | 2474 | VTGYRLFQQIS | 19401 | 0.876 | 2357 | 0.47 |
| array2.14 | 2475 | VTGYRLFQQAS | 4351 | 1.111 | 311.1 | 0.3392 |
| array2.15 | 2476 | VTGYRLFQQES | 5197 | 7.486 | 198.7 | 0.797 |
| array2.16 | 2477 | VTGYRLFQEIS | 1321 | 2.561 | 112.6 | 0.5939 |
| array2.17 | 2478 | VTGYRLFQEAS | ND | ND | ND | ND |
| array2.18 | 2479 | VTGYRLFQEES | 5112 | 67.32 | 426.5 | 11.22 |
| array2.19 | 2480 | VTGYRLFEKIS | 122961 | 0.6047 | 11827 | 0.2689 |
| array2.20 | 2481 | VTGYRLFEKAS | 36284 | 1.794 | 935.8 | 0.09793 |
| array2.21 | 2482 | VTGYRLFEKES | 8622 | 1.491 | 599.7 | 0.3267 |
| array2.22 | 2483 | VTGYRLFEQIS | 121402 | 10.78 | 3711 | 1.121 |
| array2.23 | 2484 | VTGYRLFEQAS | 3824 | 4.174 | 243.4 | 0.8621 |
| array2.24 | 2485 | VTGYRLFEQES | 1829 | 7.832 | 24.45 | 0.2891 |
| array2.25 | 2486 | VTGYRLFEEIS | ND | ND | ND | ND |
| array2.26 | 2487 | VTGYRLFEEAS | ND | ND | ND | ND |
| array2.27 | 2488 | VTGYRLFEEES | ND | ND | ND | ND |
| array2.28 | 2489 | VTGYRLFKKIL | 140640 | 0.07664 | 6033 | 0.02 |
| array2.29 | 2490 | VTGYRLFKKAL | 98575 | 0.2755 | 1679 | 0.0168 |
| array2.30 | 2491 | VTGYRLFKKEL | 51143 | 0.6714 | 2000 | 0.07542 |
| array2.31 | 2492 | VTGYRLFKQIL | 115248 | 2.989 | 2995 | 0.3361 |
| array2.32 | 2493 | VTGYRLFKQAL | 34875 | 3.561 | 496 | 0.1247 |
| array2.33 | 2494 | VTGYRLFKQEL | 8548 | 1.953 | 581.1 | 0.5209 |
| array2.34 | 2495 | VTGYRLFKEIL | 21933 | 4.405 | 867.2 | 0.7072 |
| array2.35 | 2496 | VTGYRLFKEAL | 5547 | 5.153 | 180.1 | 0.6609 |
| array2.36 | 2497 | VTGYRLFKEEL | 1720 | 7.785 | 75.68 | 1.256 |
| array2.37 | 2498 | VTGYRLFQKIL | 127404 | 0.3625 | 7870 | 0.1108 |
| array2.38 | 2499 | VTGYRLFQKAL | 72788 | 0.9748 | 3853 | 0.1796 |
| array2.39 | 2500 | VTGYRLFQKEL | 33109 | 2.477 | 687.6 | 0.1414 |
| array2.40 | 2501 | VTGYRLFQQIL | 66256 | 122.3 | 13366 | 40.42 |

TABLE 10-continued

| | SEQ ID NO: | Peptide Sequence | Bmax | Kd | Bmax | Kd |
|---|---|---|---|---|---|---|
| array2.41 | 2502 | VTGYRLFQQAL | 3472 | 3.97 | 314 | 1.484 |
| array2.42 | 2503 | VTGYRLFQQEL | 14230 | 18.99 | 180.8 | 0.714 |
| array2.43 | 2504 | VTGYRLFQEIL | 9406 | 17.25 | 544.2 | 2.141 |
| array2.44 | 2505 | VTGYRLFQEAL | 4233 | 15.99 | 426.5 | 4.994 |
| array2.45 | 2506 | VTGYRLFQEEL | 14254 | 35.43 | 614.2 | 3.766 |
| array2.46 | 2507 | VTGYRLFEKIL | 219381 | 1.917 | 7349 | 0.2965 |
| array2.47 | 2508 | VTGYRLFEKAL | 34526 | 1.807 | 1377 | 0.216 |
| array2.48 | 2509 | VTGYRLFEKEL | 10865 | 2.437 | 823.9 | 0.5103 |
| array2.49 | 2510 | VTGYRLFEQIL | 99205 | 124.3 | 2780 | 5.68 |
| array2.50 | 2511 | VTGYRLFEQAL | 17117 | 40.4 | 294 | 1.642 |
| array2.51 | 2512 | VTGYRLFEQEL | 46162 | 85 | 1436 | 4.881 |
| array2.52 | 2513 | VTGYRLFEEIL | 15703 | 104.1 | 560 | 6.409 |
| array2.53 | 2514 | VTGYRLFEEAL | ND | ND | ND | ND |
| array2.54 | 2515 | VTGYRLFEEEL | 251166 | 68.27 | 15593 | 5.901 |
| array2.55 | 2516 | VEGYRLFKKIS | 42384 | 0.07805 | 3011 | 0.02593 |
| array2.56 | 2517 | VEGYRLFKKAS | 15920 | 0.6409 | 510.2 | 0.05975 |
| array2.57 | 2518 | VEGYRLFKKES | 3374 | 0.891 | 142.5 | 0.1335 |
| array2.58 | 2519 | VEGYRLFKQIS | 21512 | 2.091 | 665.9 | 0.244 |
| array2.59 | 2520 | VEGYRLFKQAS | 2300 | 2.088 | 74.01 | 0.1938 |
| array2.60 | 2521 | VEGYRLFKQES | 4346 | 10.64 | 91.51 | 0.7646 |
| array2.61 | 2522 | VEGYRLFKEIS | 5459 | 14.43 | 116.8 | 0.7024 |
| array2.62 | 2523 | VEGYRLFKEAS | 2375 | 22.05 | 112.3 | 2.964 |
| array2.63 | 2524 | VEGYRLFKEES | 17264 | 220.3 | 3074 | 54.34 |
| array2.64 | 2525 | VEGYRLFQKIS | 36517 | 0.5863 | 781.4 | 0.05853 |
| array2.65 | 2526 | VEGYRLFQKAS | 10620 | 1.929 | 271.7 | 0.1454 |
| array2.66 | 2527 | VEGYRLFQKES | 3489 | 2.87 | 132.3 | 0.3846 |
| array2.67 | 2528 | VEGYRLFQQIS | 5223 | 8.143 | 199.6 | 0.8457 |
| array2.68 | 2529 | VEGYRLFQQAS | 3753 | 20.01 | 117.8 | 1.833 |
| array2.69 | 2530 | VEGYRLFQQES | ND | ND | ND | ND |
| array2.70 | 2531 | VEGYRLFQEIS | 29161 | 230.2 | 560.4 | 6.062 |
| array2.71 | 2532 | VEGYRLFQEAS | 44893 | 24.03 | 1778 | 1.825 |
| array2.72 | 2533 | VEGYRLFQEES | ND | ND | ND | ND |
| array2.73 | 2534 | VEGYRLFEKIS | 22544 | 2.148 | 641.3 | 0.2291 |
| array2.74 | 2535 | VEGYRLFEKAS | 3808 | 4.138 | 122.2 | 0.3119 |
| array2.75 | 2536 | VEGYRLFEKES | 1170 | 2.969 | 136.7 | 1.282 |
| array2.76 | 2537 | VEGYRLFEQIS | 17957 | 52.79 | 724 | 4.614 |
| array2.77 | 2538 | VEGYRLFEQAS | 26862 | 48.29 | 436.5 | 1.752 |
| array2.78 | 2539 | VEGYRLFEQES | 39375 | 252.3 | 4842 | 41.61 |
| array2.79 | 2540 | VEGYRLFEEIS | ND | ND | ND | ND |

TABLE 10-continued

| | SEQ ID NO: | Peptide Sequence | Bmax | Kd | Bmax | Kd |
|---|---|---|---|---|---|---|
| array2.80 | 2541 | VEGYRLFEEAS | 383183 | 1419 | 572696 | 2258 |
| array2.81 | 2542 | VEGYRLFEEES | ND | ND | ND | ND |
| array2.82 | 2543 | VEGYRLFKKIL | 43371 | 0.563 | 2640 | 0.16 |
| array2.83 | 2544 | VEGYRLFKKAL | 20849 | 1.588 | 591.2 | 0.1396 |
| array2.84 | 2545 | VEGYRLFKKEL | 7828 | 1.413 | ND | ND |
| array2.85 | 2546 | VEGYRLFKQIL | 31425 | 10.34 | 358.7 | 0.2986 |
| array2.86 | 2547 | VEGYRLFKQAL | 2304 | 2.274 | 54.26 | 0.2428 |
| array2.87 | 2548 | VEGYRLFKQEL | 1790 | 12.59 | 113 | 2.614 |
| array2.88 | 2549 | VEGYRLFKEIL | 9831 | 17.75 | 551.8 | 3.002 |
| array2.89 | 2550 | VEGYRLFKEAL | 5574 | 42.42 | 435.1 | 7.715 |
| array2.90 | 2551 | VEGYRLFKEEL | 12241 | 100.9 | 458.5 | 6.589 |
| array2.91 | 2552 | VEGYRLFQKIL | 50503 | 2.077 | 2173 | 0.3373 |
| array2.92 | 2553 | VEGYRLFQKAL | 12294 | 2.023 | 430.5 | 0.206 |
| array2.93 | 2554 | VEGYRLFQKEL | 4090 | 1.691 | 278.5 | 0.4617 |
| array2.94 | 2555 | VEGYRLFQQIL | 2281 | 9.39 | 112 | 1.201 |
| array2.95 | 2556 | VEGYRLFQQAL | 38229 | 18.81 | 1578 | 1.617 |
| array2.96 | 2557 | VEGYRLFQQEL | 104621 | 99.4 | 6265 | 10.43 |
| array2.97 | 2558 | VEGYRLFQEIL | ND | ND | ND | ND |
| array2.98 | 2559 | VEGYRLFQEAL | 2696 | 99.9 | 238.8 | 15.53 |
| array2.99 | 2560 | VEGYRLFQEEL | ND | ND | ND | ND |
| array2.100 | 2561 | VEGYRLFEKIL | 34989 | 10.56 | 1747 | 1.801 |
| array2.101 | 2562 | VEGYRLFEKAL | 6372 | 12.62 | 186 | 0.8756 |
| array2.102 | 2563 | VEGYRLFEKEL | 961.5 | 5.786 | 67.06 | 1.216 |
| array2.103 | 2564 | VEGYRLFEQIL | ND | ND | ND | ND |
| array2.104 | 2565 | VEGYRLFEQAL | 9882 | 335.8 | 544.7 | 23.35 |
| array2.105 | 2566 | VEGYRLFEQEL | ND | ND | ND | ND |
| array2.106 | 2567 | VEGYRLFEEIL | ND | ND | ND | ND |
| array2.107 | 2568 | VEGYRLFEEAL | ND | ND | ND | ND |
| array2.108 | 2569 | VEGYRLFEEEL | ND | ND | ND | ND |

Example 153

Dark Peptides and Quencher Peptides for Reducing Background Signal from NLpoly11S A purified sample of NLpoly11S was diluted into NANO-GLO reagent to give a final concentration of 2 uM. Pep86 is a high affinity luminogenic peptide and was used to induce maximum signal for NLpoly11S. Pep86 was prepared at 1 nM in PBS (pH 7.2) for a working solution. Dark peptide and quencher peptides (FIG. 180) were dissolved to 1 mM (or lower) in either PBS pH 7.2 or 150 mM NH4HCO3 and added in equal volume to the NANOGLO/NLpoly11S and then samples were read on a Tecan Infinite F500 reader using a 5 min time point.

FIG. 202A shows that both GWALFKK (SEQ ID NO: 2351) and Dabcyl-GWALFKK (SEQ ID NO: 2351) reduce the background luminescence generated by NLpoly11S in the absence of any other luminogenic peptide. FIG. 202B shows that Pep86 is able to induce luminescence even in the presence of GWALFKK (SEQ ID NO: 2351) and Dabcyl-GWALFKK (SEQ ID NO: 2351).

FIG. 203A shows that VTGWALFEEIL (SEQ ID NO: 2372) (Trp 11mer) and VTGYALFEEIL (SEQ ID NO: 2355) (Tyr 1 mer) induce luminescence over background (NLpoly11S alone: no peptide control), but that the N-terminal Dabcyl versions of each provide significant quenching of this signal. FIG. 203B shows that Pep86 is able to induce luminescence even in the presence of the Dabcyl versions of Trp 11 mer and Tyr 11mer.

All publications and patents mentioned in the above specification are herein incorporated by reference. Various modifications and variations of the described method and system of the invention will be apparent to those skilled in the art without departing from the scope and spirit of the invention. Although the invention has been described in connection with specific embodiments, it should be understood that the invention as claimed should not be unduly limited to such specific embodiments. Indeed, various modifications of the described modes for carrying out the invention that are obvious to those skilled in the relevant fields are intended to be within the scope of the present invention.

SEQUENCE LISTING (2587 sequences)

SEQ ID NO: 1 - DNA, 42 bp, Artificial Sequence
  Synthetic
atgggagtgaccggctggcggctgtgcgaacgcattctggcg

SEQ ID NO: 2 - protein, 14 aa, Artificial Sequence
  Synthetic
MGVTGWRLCERILA

SEQ ID NO: 3 - DNA, 42 bp, Artificial Sequence
  Synthetic
atggacgtgaccggctggcggctgtgcgaacgcattctggcg

SEQ ID NO: 4 - protein, 14 aa, Artificial Sequence
  Synthetic
MDVTGWRLCERILA

SEQ ID NO: 5 - DNA, 42 bp, Artificial Sequence
  Synthetic
atgggagtgaccgcctggcggctgtgcgaacgcattctggcg

SEQ ID NO: 6 - protein, 14 aa, Artificial Sequence
  Synthetic
MGVTAWRLCERILA

SEQ ID NO: 7 - DNA, 42 bp, Artificial Sequence
  Synthetic
atgggagtgaccggctggcggctgtgcaagcgcattctggcg

SEQ ID NO: 8 - protein, 14 aa, Artificial Sequence
  Synthetic
MGVTGWRLCKRILA

SEQ ID NO: 9 - DNA, 42 bp, Artificial Sequence
  Synthetic
atgggagtgaccggctggcggctgtgcgaacgcattagcgcg

SEQ ID NO: 10 - protein, 14 aa, Artificial Sequence
  Synthetic
MGVTGWRLCERISA

SEQ ID NO: 11 - DNA, 42 bp, Artificial Sequence
  Synthetic
atggacgtgaccggctggcggctgtgcaagcgcattagcgcg

SEQ ID NO: 12 - protein, 14 aa, Artificial Sequence
  Synthetic
MDVTGWRLCKRISA

SEQ ID NO: 13 - DNA, 42 bp, Artificial Sequence
  Synthetic
atggacgtgaccggctggcggctgtgcaagcgcattctggcg

SEQ ID NO: 14 - protein, 14 aa, Artificial Sequence
  Synthetic
MDVTGWRLCKRILA

SEQ ID NO: 15 - DNA, 42 bp, Artificial Sequence
  Synthetic
atggacgtgaccggctggcggctgtgcgaacgcattagcgcg

SEQ ID NO: 16 - protein, 14 aa, Artificial Sequence
  Synthetic
MDVTGWRLCERISA

SEQ ID NO: 17 - DNA, 42 bp, Artificial Sequence
  Synthetic
atgggagtgaccggctggcggctgtgcaagcgcattagcgcg

SEQ ID NO: 18 - protein, 14 aa, Artificial Sequence
  Synthetic
MGVTGWRLCKRISA

SEQ ID NO: 19 - DNA, 42 bp, Artificial Sequence
  Synthetic
atgggagtgaccggctggcggctgaacgaacgcattctggcg

SEQ ID NO: 20 - protein, 14 aa, Artificial Sequence
  Synthetic
MGVTGWRLNERILA

SEQ ID NO: 21 - DNA, 42 bp, Artificial Sequence
  Synthetic
atgggagtgaccggctggcggctgcaggaacgcattctggcg

SEQ ID NO: 22 - protein, 14 aa, Artificial Sequence
  Synthetic
MGVTGWRLQERILA

SEQ ID NO: 23 - DNA, 42 bp, Artificial Sequence
  Synthetic
atgggagtgaccggctggcggctgaagaagcgccggagccgg

SEQ ID NO: 24 - protein, 14 aa, Artificial Sequence
  Synthetic
MGVTGWRLKKRRSR

SEQ ID NO: 25 - DNA, 42 bp, Artificial Sequence
  Synthetic
atgaacgtgaccggctggcggctgtgcaagcgcattagcgcg

SEQ ID NO: 26 - protein, 14 aa, Artificial Sequence
  Synthetic
MNVTGWRLCKRISA

SEQ ID NO: 27 - DNA, 42 bp, Artificial Sequence
  Synthetic
atgagcgtgaccggctggcggctgtgcaagcgcattagcgcg

SEQ ID NO: 28 - protein, 14 aa, Artificial Sequence
  Synthetic
MSVTGWRLCKRISA

SEQ ID NO: 29 - DNA, 42 bp, Artificial Sequence
  Synthetic
atggaggtgaccggctggcggctgtgcaagcgcattagcgcg

SEQ ID NO: 30 - protein, 14 aa, Artificial Sequence
  Synthetic
MEVTGWRLCKRISA

SEQ ID NO: 31 - DNA, 42 bp, Artificial Sequence
  Synthetic
atgggcgtgaccggctggcggctgtgcaagcgcattagcgcg

SEQ ID NO: 32 - protein, 14 aa, Artificial Sequence
  Synthetic
MHVTGWRLCKRISA

SEQ ID NO: 33 - DNA, 42 bp, Artificial Sequence
  Synthetic
atgggacacaccggctggcggctgtgcaagcgcattagcgcg

SEQ ID NO: 34 - protein, 14 aa, Artificial Sequence
  Synthetic
MGITGWRLCKRISA

SEQ ID NO: 35 - DNA, 42 bp, Artificial Sequence
  Synthetic
atgggagccaccggctggcggctgtgcaagcgcattagcgcg

SEQ ID NO: 36 - protein, 14 aa, Artificial Sequence
  Synthetic
MGATGWRLCKRISA

SEQ ID NO: 37 - DNA, 42 bp, Artificial Sequence
  Synthetic
atgggaaagaccggctggcggctgtgcaagcgcattagcgcg

SEQ ID NO: 38 - protein, 14 aa, Artificial Sequence
  Synthetic
MGKTGWRLCKRISA

SEQ ID NO: 39 - DNA, 42 bp, Artificial Sequence
  Synthetic
atgggacagaccggctggcggctgtgcaagcgcattagcgcg

SEQ ID NO: 40 - protein, 14 aa, Artificial Sequence
  Synthetic
MGQTGWRLCKRISA

SEQ ID NO: 41 - DNA, 42 bp, Artificial Sequence
  Synthetic
atgggaagcaccggctggcggctgtgcaagcgcattagcgcg

SEQ ID NO: 42 - protein, 14 aa, Artificial Sequence
  Synthetic
MGSTGWRLCKRISA

SEQ ID NO: 43 - DNA, 42 bp, Artificial Sequence
  Synthetic
atgggagtggtgggctggcggctgtgcaagcgcattagcgcg

SEQ ID NO: 44 - protein, 14 aa, Artificial Sequence
  Synthetic
MGVVGWRLCKRISA

SEQ ID NO: 45 - DNA, 42 bp, Artificial Sequence
  Synthetic
atgggagtgaagggctggcggctgtgcaagcgcattagcgcg

SEQ ID NO: 46 - protein, 14 aa, Artificial Sequence
  Synthetic
MGVKGWRLCKRISA

SEQ ID NO: 47 - DNA, 42 bp, Artificial Sequence
  Synthetic
atgggagtgcagggctggcggctgtgcaagcgcattagcgcg

SEQ ID NO: 48 - protein, 14 aa, Artificial Sequence
  Synthetic
MGVQGWRLCKRISA

SEQ ID NO: 49 - DNA, 42 bp, Artificial Sequence
  Synthetic
atgggagtgaccggcacccggctgtgcaagcgcattagcgcg

SEQ ID NO: 50 - protein, 14 aa, Artificial Sequence
  Synthetic
MGVTGTRLCKRISA

SEQ ID NO: 51 - DNA, 42 bp, Artificial Sequence
  Synthetic
atgggagtgaccggcaagcggctgtgcaagcgcattagcgcg

SEQ ID NO: 52 - protein, 14 aa, Artificial Sequence
  Synthetic
MGVTGKRLCKRISA

SEQ ID NO: 53 - DNA, 42 bp, Artificial Sequence
  Synthetic
atgggagtgaccggcgtgcggctgtgcaagcgcattagcgcg

SEQ ID NO: 54 - protein, 14 aa, Artificial Sequence
  Synthetic
MGVTGVRLCKRISA

SEQ ID NO: 55 - DNA, 42 bp, Artificial Sequence
  Synthetic
atgggagtgaccggctggcggcactgcaagcgcattagcgcg

SEQ ID NO: 56 - protein, 14 aa, Artificial Sequence
  Synthetic
MGVTGWRICKRISA

SEQ ID NO: 57 - DNA, 42 bp, Artificial Sequence
  Synthetic
atgggagtgaccggctggcgggtgtgcaagcgcattagcgcg

SEQ ID NO: 58 - protein, 14 aa, Artificial Sequence
  Synthetic
MGVTGWRVCKRISA

SEQ ID NO: 59 - DNA, 42 bp, Artificial Sequence
  Synthetic
atgggagtgaccggctggcggacctgcaagcgcattagcgcg

SEQ ID NO: 60 - protein, 14 aa, Artificial Sequence
  Synthetic
MGVTGWRTCKRISA

SEQ ID NO: 61 - DNA, 42 bp, Artificial Sequence
  Synthetic
atgggagtgaccggctggcggtactgcaagcgcattagcgcg

SEQ ID NO: 62 - protein, 14 aa, Artificial Sequence
  Synthetic
MGVTGWRYCKRISA

SEQ ID NO: 63 - DNA, 42 bp, Artificial Sequence
  Synthetic
atgggagtgaccggctggcggaagtgcaagcgcattagcgcg

SEQ ID NO: 64 - protein, 14 aa, Artificial Sequence
  Synthetic
MGVTGWRKCKRISA

SEQ ID NO: 65 - DNA, 42 bp, Artificial Sequence
  Synthetic
atgggagtgaccggctggcggctgaacaagcgcattagcgcg

SEQ ID NO: 66 - protein, 14 aa, Artificial Sequence
  Synthetic
MGVTGWRLNKRISA

SEQ ID NO: 67 - DNA, 42 bp, Artificial Sequence
  Synthetic
atgggagtgaccggctggcggctgaccaagcgcattagcgcg

SEQ ID NO: 68 - protein, 14 aa, Artificial Sequence
  Synthetic
MGVTGWRLTKRISA

SEQ ID NO: 69 - DNA, 42 bp, Artificial Sequence
  Synthetic
atgggagtgaccggctggcggctgtgcaagaagattagcgcg

SEQ ID NO: 70 - protein, 14 aa, Artificial Sequence
  Synthetic
MGVTGWRLCKKISA

SEQ ID NO: 71 - DNA, 42 bp, Artificial Sequence
  Synthetic
atgggagtgaccggctggcggctgtgcaagaacattagcgcg

SEQ ID NO: 72 - protein, 14 aa, Artificial Sequence
  Synthetic
MGVTGWRLCKNISA

SEQ ID NO: 73 - DNA, 42 bp, Artificial Sequence
  Synthetic
atgggagtgaccggctggcggctgtgcaagcgcgtgagcgcg

SEQ ID NO: 74 - protein, 14 aa, Artificial Sequence
  Synthetic
MGVTGWRLCKRVSA

SEQ ID NO: 75 - DNA, 42 bp, Artificial Sequence
  Synthetic
atgggagtgaccggctggcggctgtgcaagcgccagagcgcg

SEQ ID NO: 76 - protein, 14 aa, Artificial Sequence
  Synthetic
MGVTGWRLCKRQSA

SEQ ID NO: 77 - DNA, 42 bp, Artificial Sequence
  Synthetic
atgggagtgaccggctggcggctgtgcaagcgcgagagcgcg

SEQ ID NO: 78 - protein, 14 aa, Artificial Sequence
  Synthetic
MGVTGWRLCKRESA

SEQ ID NO: 79 - DNA, 42 bp, Artificial Sequence
  Synthetic
atgggagtgaccggctggcggctgtgcaagcgccggagcgcg

SEQ ID NO: 80 - protein, 14 aa, Artificial Sequence
  Synthetic
MGVTGWRLCKRRSA

SEQ ID NO: 81 - DNA, 42 bp, Artificial Sequence
  Synthetic
atgggagtgaccggctggcggctgtgcaagcgcttcagcgcg

SEQ ID NO: 82 - protein, 14 aa, Artificial Sequence
  Synthetic
MGVTGWRLCKRFSA

SEQ ID NO: 83 - DNA, 42 bp, Artificial Sequence
  Synthetic
atgggagtgaccggctggcggctgtgcaagcgcattagcaac

SEQ ID NO: 84 - protein, 14 aa, Artificial Sequence
  Synthetic
MGVTGWRLCKRISN

SEQ ID NO: 85 - DNA, 42 bp, Artificial Sequence
  Synthetic
atgggagtgaccggctggcggctgtgcaagcgcattagcacc

SEQ ID NO: 86 - protein, 14 aa, Artificial Sequence
  Synthetic
MGVTGWRLCKRIST

SEQ ID NO: 87 - DNA, 42 bp, Artificial Sequence
  Synthetic
atgggagtgaccggctggcggctgtgcaagcgcattagccgg

SEQ ID NO: 88 - protein, 14 aa, Artificial Sequence
  Synthetic
MGVTGWRLCKRISR

SEQ ID NO: 89 - DNA, 42 bp, Artificial Sequence
  Synthetic
atgggagtgaccggctggcggctgtgcaagcgcattagcctg

SEQ ID NO: 90 - protein, 14 aa, Artificial Sequence
  Synthetic
MGVTGWRLCKRISL

SEQ ID NO: 91 - DNA, 42 bp, Artificial Sequence
  Synthetic
atgggagtgaccggctggcggctgtgcaagcgcattagcgag

SEQ ID NO: 92 - protein, 14 aa, Artificial Sequence
  Synthetic
MGVTGWRLCKRISE

SEQ ID NO: 93 - DNA, 42 bp, Artificial Sequence
  Synthetic
atgggagtgaccggcttccggctgtgcaagcgcattagcgcg

SEQ ID NO: 94 - protein, 14 aa, Artificial Sequence
  Synthetic
MGVTGFRLCKRISA

SEQ ID NO: 95 - DNA, 42 bp, Artificial Sequence
  Synthetic
atgggagtgaccggctaccggctgtgcaagcgcattagcgcg

SEQ ID NO: 96 - protein, 14 aa, Artificial Sequence
  Synthetic
MGVTGYRLCKRISA

SEQ ID NO: 97 - DNA, 42 bp, Artificial Sequence
  Synthetic
atgggagtgaccggcgagcggctgtgcaagcgcattagcgcg

SEQ ID NO: 98 - protein, 14 aa, Artificial Sequence
  Synthetic
MGVTGERLCKRISA

SEQ ID NO: 99 - DNA, 42 bp, Artificial Sequence
  Synthetic
atgcaggtgaccggctggcggctgtgcaagcgcattagcgcg

SEQ ID NO: 100 - protein, 14 aa, Artificial Sequence
  Synthetic
MQVTGWRLCKRISA

SEQ ID NO: 101 - DNA, 42 bp, Artificial Sequence
  Synthetic
atgaccgtgaccggctggcggctgtgcaagcgcattagcgcg

SEQ ID NO: 102 - protein, 14 aa, Artificial Sequence
  Synthetic
MTVTGWRLCKRISA

SEQ ID NO: 103 - DNA, 42 bp, Artificial Sequence
  Synthetic
atgggagtggagggctggcggctgtgcaagcgcattagcgcg

SEQ ID NO: 104 - protein, 14 aa, Artificial Sequence
  Synthetic
MGVEGWRLCKRISA

SEQ ID NO: 105 - DNA, 42 bp, Artificial Sequence
  Synthetic
atgggagtgaccggctggcggctgttcaagcgcattagcgcg

SEQ ID NO: 106 - protein, 14 aa, Artificial Sequence
  Synthetic
MGVTGWRLFKRISA

SEQ ID NO: 107 - DNA, 42 bp, Artificial Sequence
  Synthetic
atgggagtgaccggctggcggctgtacaagcgcattagcgcg

SEQ ID NO: 108 - protein, 14 aa, Artificial Sequence
  Synthetic
MGVTGWRLYKRISA

SEQ ID NO: 109 - DNA, 42 bp, Artificial Sequence
  Synthetic
atgggagtgaccggctggcggctgagcaagcgcattagcgcg

SEQ ID NO: 110 - protein, 14 aa, Artificial Sequence
  Synthetic
MGVTGWRLSKRISA

SEQ ID NO: 111 - DNA, 42 bp, Artificial Sequence
  Synthetic
atgggagtgaccggctggcggctgggcaagcgcattagcgcg

SEQ ID NO: 112 - protein, 14 aa, Artificial Sequence
  Synthetic
MGVTGWRLHKRISA

SEQ ID NO: 113 - DNA, 42 bp, Artificial Sequence
  Synthetic
atgggagtgaccggctggcggctgatgaagcgcattagcgcg

SEQ ID NO: 114 - protein, 14 aa, Artificial Sequence
  Synthetic
MGVTGWRLMKRISA

SEQ ID NO: 115 - DNA, 42 bp, Artificial Sequence
  Synthetic
atgggagtgaccggctggcggctggccaagcgcattagcgcg

SEQ ID NO: 116 - protein, 14 aa, Artificial Sequence
  Synthetic
MGVTGWRLAKRISA

SEQ ID NO: 117 - DNA, 42 bp, Artificial Sequence
  Synthetic
atgggagtgaccggctggcggctgcagaagcgcattagcgcg

SEQ ID NO: 118 - protein, 14 aa, Artificial Sequence
  Synthetic
MGVTGWRLQKRISA

SEQ ID NO: 119 - DNA, 42 bp, Artificial Sequence
  Synthetic
atgggagtgaccggctggcggctgctgaagcgcattagcgcg

SEQ ID NO: 120 - protein, 14 aa, Artificial Sequence
  Synthetic
MGVTGWRLLKRISA

SEQ ID NO: 121 - DNA, 42 bp, Artificial Sequence
  Synthetic
atgggagtgaccggctggcggctgaagaagcgcattagcgcg

SEQ ID NO: 122 - protein, 14 aa, Artificial Sequence
  Synthetic
MGVTGWRLKKRISA

SEQ ID NO: 123 - DNA, 42 bp, Artificial Sequence
  Synthetic
atgaaccacaccggctggcggctgaacaagaaggtgagcaac

SEQ ID NO: 124 - protein, 14 aa, Artificial Sequence
  Synthetic
MNITGWRLNKKVSN

SEQ ID NO: 125 - DNA, 42 bp, Artificial Sequence
  Synthetic
atgaaccacaccggctaccggctgaacaagaaggtgagcaac

SEQ ID NO: 126 - protein, 14 aa, Artificial Sequence
  Synthetic
MNITGYRLNKKVSN

SEQ ID NO: 127 - DNA, 42 bp, Artificial Sequence
  Synthetic
atgtgcgtgaccggctggcggctgttcaagcgcattagcgcg

SEQ ID NO: 128 - protein, 14 aa, Artificial Sequence
  Synthetic
MCVTGWRLFKRISA

SEQ ID NO: 129 - DNA, 42 bp, Artificial Sequence
  Synthetic
atgcccgtgaccggctggcggctgttcaagcgcattagcgcg

SEQ ID NO: 130 - protein, 14 aa, Artificial Sequence
  Synthetic
MPVTGWRLFKRISA

SEQ ID NO: 131 - DNA, 42 bp, Artificial Sequence
  Synthetic
atgaaccacaccggctaccggctgttcaagaaggtgagcaac

SEQ ID NO: 132 - protein, 14 aa, Artificial Sequence
  Synthetic
MNITGYRLFKKVSN

SEQ ID NO: 133 - DNA, 42 bp, Artificial Sequence
  Synthetic
atgaacgtgaccggctaccggctgttcaagaaggtgagcaac

SEQ ID NO: 134 - protein, 14 aa, Artificial Sequence
  Synthetic
MNVTGYRLFKKVSN

SEQ ID NO: 135 - DNA, 42 bp, Artificial Sequence
  Synthetic
atgaacgtgaccggctggcggctgttcaagaaggtgagcaac

SEQ ID NO: 136 - protein, 14 aa, Artificial Sequence
  Synthetic
MNVTGWRLFKKVSN

SEQ ID NO: 137 - DNA, 42 bp, Artificial Sequence
  Synthetic
atgaacgtgaccggctggcggctgttcaagaagattagcaac

SEQ ID NO: 138 - protein, 14 aa, Artificial Sequence
  Synthetic
MNVTGWRLFKKISN

SEQ ID NO: 139 - DNA, 42 bp, Artificial Sequence
  Synthetic
atgaacgtgaccggctggcggctgttcaagcgcattagcaac

SEQ ID NO: 140 - protein, 14 aa, Artificial Sequence
  Synthetic
MNVTGWRLFKRISN

SEQ ID NO: 141 - DNA, 42 bp, Artificial Sequence
  Synthetic
atgggagtgaccggctggcggctgttcaagcgcattagcaac

SEQ ID NO: 142 - protein, 14 aa, Artificial Sequence
  Synthetic
MGVTGWRLFKRISN

SEQ ID NO: 143 - DNA, 42 bp, Artificial Sequence
  Synthetic
atgaacgtgaccggctggcggctgttcgaacgcattagcaac

SEQ ID NO: 144 - protein, 14 aa, Artificial Sequence
  Synthetic
MNVTGWRLFERISN

SEQ ID NO: 145 - DNA, 42 bp, Artificial Sequence
  Synthetic
atgaacgtgaccggctggcggctgttcaagcgcattctgaac

SEQ ID NO: 146 - protein, 14 aa, Artificial Sequence
  Synthetic
MNVTGWRLFKRILN

SEQ ID NO: 147 - DNA, 42 bp, Artificial Sequence
  Synthetic
atgaacgtgaccggctggcggctgttcaagcgcattagcgcg

SEQ ID NO: 148 - protein, 14 aa, Artificial Sequence
  Synthetic
MNVTGWRLFKRISA

SEQ ID NO: 149 - DNA, 42 bp, Artificial Sequence
  Synthetic
atgaacgtgaccggctggcggctgttcgaaaagattagcaac

SEQ ID NO: 150 - protein, 14 aa, Artificial Sequence
  Synthetic
MNVTGWRLFEKISN

SEQ ID NO: 151 - DNA, 42 bp, Artificial Sequence
  Synthetic
atgaacgtgagcggctggcggctgttcgaaaagattagcaac

SEQ ID NO: 152 - protein, 14 aa, Artificial Sequence
  Synthetic
MNVSGWRLFEKISN

SEQ ID NO: 153 - DNA, 39 bp, Artificial Sequence
  Synthetic
atggtgaccggctggcggctgttcaagaagattagcaac

SEQ ID NO: 154 - protein, 13 aa, Artificial Sequence
  Synthetic
MVTGWRLFKKISN

SEQ ID NO: 155 - DNA, 42 bp, Artificial Sequence
  Synthetic
atgaacgtgagcggctggcggctgttcaagaagattagcaac

SEQ ID NO: 156 - protein, 14 aa, Artificial Sequence
  Synthetic
MNVSGWRLFKKISN

SEQ ID NO: 157 - DNA, 42 bp, Artificial Sequence
  Synthetic
atgaacgtgaccggctaccggctgttcaagaagattagcaac

SEQ ID NO: 158 - protein, 14 aa, Artificial Sequence
  Synthetic
MNVTGYRLFKKISN

SEQ ID NO: 159 - DNA, 39 bp, Artificial Sequence
  Synthetic
atggtgagcggctggcggctgttcaagaagattagcaac

SEQ ID NO: 160 - protein, 13 aa, Artificial Sequence
  Synthetic
MVSGWRLFKKISN

SEQ ID NO: 161 - DNA, 36 bp, Artificial Sequence
  Synthetic
atgagcggctggcggctgttcaagaagattagcaac

SEQ ID NO: 162 - protein, 12 aa, Artificial Sequence
  Synthetic
MSGWRLFKKISN

SEQ ID NO: 163 - DNA, 33 bp, Artificial Sequence
  Synthetic
atgggctggcggctgttcaagaagattagcaac

SEQ ID NO: 164 - protein, 11 aa, Artificial Sequence
  Synthetic
MGWRLFKKISN

SEQ ID NO: 165 - DNA, 39 bp, Artificial Sequence
  Synthetic
atgaacgtgagcggctggcggctgttcaagaagattagc

SEQ ID NO: 166 - protein, 13 aa, Artificial Sequence
  Synthetic
MNVSGWRLFKKIS

SEQ ID NO: 167 - DNA, 36 bp, Artificial Sequence
  Synthetic
atgaacgtgagcggctggcggctgttcaagaagatt

SEQ ID NO: 168 - protein, 12 aa, Artificial Sequence
  Synthetic
MNVSGWRLFKKI

SEQ ID NO: 169 - DNA, 33 bp, Artificial Sequence
  Synthetic
atgaacgtgagcggctggcggctgttcaagaag

SEQ ID NO: 170 - protein, 11 aa, Artificial Sequence
  Synthetic
MNVSGWRLFKK

SEQ ID NO: 171 - DNA, 36 bp, Artificial Sequence
  Synthetic
atggtgagcggctggcggctgttcaagaagattagc

SEQ ID NO: 172 - protein, 12 aa, Artificial Sequence
  Synthetic
MVSGWRLFKKIS

SEQ ID NO: 173 - DNA, 30 bp, Artificial Sequence
  Synthetic
atgagcggctggcggctgttcaagaagatt

SEQ ID NO: 174 - protein, 10 aa, Artificial Sequence
  Synthetic
MSGWRLFKKI

SEQ ID NO: 175 - DNA, 42 bp, Artificial Sequence
  Synthetic
atgaacgtgagcggctggggcctgttcaagaagattagcaac

SEQ ID NO: 176 - protein, 14 aa, Artificial Sequence
  Synthetic
MNVSGWGLFKKISN

SEQ ID NO: 177 - DNA, 42 bp, Artificial Sequence
  Synthetic
atgcccgtgagcggctggcggctgttcaagaagattagcaac

SEQ ID NO: 178 - protein, 14 aa, Artificial Sequence
  Synthetic
MPVSGWRLFKKISN

SEQ ID NO: 179 - DNA, 45 bp, Artificial Sequence
  Synthetic
atgaaccccgtgagcggctggcggctgttcaagaagattagcaac

SEQ ID NO: 180 - protein, 15 aa, Artificial Sequence
  Synthetic
MNPVSGWRLFKKISN

SEQ ID NO: 181 - DNA, 48 bp, Artificial Sequence
  Synthetic
atgatcaaccccgtgagcggctggcggctgttcaagaagattagcaac

SEQ ID NO: 182 - protein, 16 aa, Artificial Sequence
  Synthetic
MINPVSGWRLFKKISN

SEQ ID NO: 183 - DNA, 51 bp, Artificial Sequence
  Synthetic
atgaccatcaaccccgtgagcggctggcggctgttcaagaagattagcaac

SEQ ID NO: 184 - protein, 17 aa, Artificial Sequence
  Synthetic
MTINPVSGWRLFKKISN

SEQ ID NO: 185 - DNA, 54 bp, Artificial Sequence
  Synthetic
atggtgaccatcaaccccgtgagcggctggcggctgttcaagaagattagcaac

SEQ ID NO: 186 - protein, 18 aa, Artificial Sequence
  Synthetic
MVTINPVSGWRLFKKISN

SEQ ID NO: 187 - DNA, 57 bp, Artificial Sequence
  Synthetic
atgcgggtgaccatcaaccccgtgagcggctggcggctgttcaagaagattagcaac

SEQ ID NO: 188 - protein, 19 aa, Artificial Sequence
  Synthetic
MRVTINPVSGWRLFKKISN

SEQ ID NO: 189 - DNA, 30 bp, Artificial Sequence
  Synthetic
atgagcggctggcggctgctgaagaagatt

SEQ ID NO: 190 - protein, 10 aa, Artificial Sequence
  Synthetic
MSGWRLLKKI

SEQ ID NO: 191 - DNA, 30 bp, Artificial Sequence
  Synthetic
atgaccggctaccggctgctgaagaagatt

SEQ ID NO: 192 - protein, 10 aa, Artificial Sequence
  Synthetic
MTGYRLLKKI

SEQ ID NO: 193 - DNA, 27 bp, Artificial Sequence
  Synthetic
atgagcggctggcggctgttcaagaag

SEQ ID NO: 194 - protein, 9 aa, Artificial Sequence
  Synthetic
MSGWRLFKK

SEQ ID NO: 195 - DNA, 36 bp, Artificial Sequence
  Synthetic
atggtgaccggctaccggctgttcaagaagattagc

SEQ ID NO: 196 - protein, 12 aa, Artificial Sequence
  Synthetic
MVTGYRLFKKIS

SEQ ID NO: 197 - DNA, 36 bp, Artificial Sequence
  Synthetic
atggtgaccggctaccggctgttcgagaagattagc

SEQ ID NO: 198 - protein, 12 aa, Artificial Sequence
  Synthetic
MVTGYRLFEKIS

SEQ ID NO: 199 - DNA, 36 bp, Artificial Sequence
  Synthetic
atggtgaccggctaccggctgttcgagcagattagc

SEQ ID NO: 200 - protein, 12 aa, Artificial Sequence
  Synthetic
MVTGYRLFEQIS

SEQ ID NO: 201 - DNA, 36 bp, Artificial Sequence
  Synthetic
atggtgaccggctaccggctgttcgagaaggagagc

SEQ ID NO: 202 - protein, 12 aa, Artificial Sequence
  Synthetic
MVTGYRLFEKES

SEQ ID NO: 203 - DNA, 36 bp, Artificial Sequence
  Synthetic
atggtgaccggctaccggctgttcgagcaggagagc

SEQ ID NO: 204 - protein, 12 aa, Artificial Sequence
  Synthetic
MVTGYRLFEQES

SEQ ID NO: 205 - DNA, 36 bp, Artificial Sequence
  Synthetic
atggtgaccggctaccggctgttcgagcaggagctg

SEQ ID NO: 206 - protein, 12 aa, Artificial Sequence
  Synthetic
MVTGYRLFEQEL

SEQ ID NO: 207 - DNA, 36 bp, Artificial Sequence
  Synthetic
atggtggagggctaccggctgttcgagaagattagc

SEQ ID NO: 208 - protein, 12 aa, Artificial Sequence
  Synthetic
MVEGYRLFEKIS

SEQ ID NO: 209 - DNA, 36 bp, Artificial Sequence
  Synthetic
atggtggagggctaccggctgttcgagcagattagc

SEQ ID NO: 210 - protein, 12 aa, Artificial Sequence
  Synthetic
MVEGYRLFEQIS

SEQ ID NO: 211 - DNA, 36 bp, Artificial Sequence
  Synthetic
atggtggagggctaccggctgttcgagaaggagagc

SEQ ID NO: 212 - protein, 12 aa, Artificial Sequence
  Synthetic
MVEGYRLFEKES

SEQ ID NO: 213 - DNA, 36 bp, Artificial Sequence
  Synthetic
atggtggagggctaccggctgttcgagcaggagagc

SEQ ID NO: 214 - protein, 12 aa, Artificial Sequence
  Synthetic
MVEGYRLFEQES

SEQ ID NO: 215 - DNA, 36 bp, Artificial Sequence
  Synthetic
atggtggagggctaccggctgttcgagcaggagctg

SEQ ID NO: 216 - protein, 12 aa, Artificial Sequence
  Synthetic
MVEGYRLFEQEL

SEQ ID NO: 217 - DNA, 36 bp, Artificial Sequence
  Synthetic
atgattagcggctggcggctgatgaagaacattagc

SEQ ID NO: 218 - protein, 12 aa, Artificial Sequence
  Synthetic
MISGWRLMKNIS

SEQ ID NO: 219 - DNA, 36 bp, Artificial Sequence
  Synthetic
atggtggagggctaccggctgttcaagaagattagc

SEQ ID NO: 220 - protein, 12 aa, Artificial Sequence
  Synthetic
MVEGYRLFKKIS

SEQ ID NO: 221 - DNA, 39 bp, Artificial Sequence
  Synthetic
gacgtgaccggctggcggctgtgcgaacgcattctggcg

SEQ ID NO: 222 - protein, 13 aa, Artificial Sequence
  Synthetic
DVTGWRLCERILA

SEQ ID NO: 223 - DNA, 39 bp, Artificial Sequence
  Synthetic
ggagtgaccgcctggcggctgtgcgaacgcattctggcg

SEQ ID NO: 224 - protein, 13 aa, Artificial Sequence
  Synthetic
GVTAWRLCERILA

SEQ ID NO: 225 - DNA, 39 bp, Artificial Sequence
  Synthetic
ggagtgaccggctggcggctgtgcaagcgcattctggcg

SEQ ID NO: 226 - protein, 13 aa, Artificial Sequence
  Synthetic
GVTGWRLCKRILA

SEQ ID NO: 227 - DNA, 39 bp, Artificial Sequence
  Synthetic
ggagtgaccggctggcggctgtgcgaacgcattagcgcg

SEQ ID NO: 228 - protein, 13 aa, Artificial Sequence
  Synthetic
GVTGWRLCERISA

SEQ ID NO: 229 - DNA, 39 bp, Artificial Sequence
  Synthetic
gacgtgaccggctggcggctgtgcaagcgcattagcgcg

SEQ ID NO: 230 - protein, 13 aa, Artificial Sequence
  Synthetic
DVTGWRLCKRISA

SEQ ID NO: 231 - DNA, 39 bp, Artificial Sequence
  Synthetic
gacgtgaccggctggcggctgtgcaagcgcattctggcg

SEQ ID NO: 232 - protein, 13 aa, Artificial Sequence
  Synthetic
DVTGWRLCKRILA

SEQ ID NO: 233 - DNA, 39 bp, Artificial Sequence
  Synthetic
gacgtgaccggctggcggctgtgcgaacgcattagcgcg

SEQ ID NO: 234 - protein, 13 aa, Artificial Sequence
  Synthetic
DVTGWRLCERISA

SEQ ID NO: 235 - DNA, 39 bp, Artificial Sequence
  Synthetic
ggagtgaccggctggcggctgtgcaagcgcattagcgcg

SEQ ID NO: 236 - protein, 13 aa, Artificial Sequence
  Synthetic
GVTGWRLCKRISA

SEQ ID NO: 237 - DNA, 39 bp, Artificial Sequence
  Synthetic
ggagtgaccggctggcggctgaacgaacgcattctggcg

SEQ ID NO: 238 - protein, 13 aa, Artificial Sequence
  Synthetic
GVTGWRLNERILA

SEQ ID NO: 239 - DNA, 39 bp, Artificial Sequence
  Synthetic
ggagtgaccggctggcggctgcaggaacgcattctggcg

SEQ ID NO: 240 - protein, 13 aa, Artificial Sequence
  Synthetic
GVTGWRLQERILA

SEQ ID NO: 241 - DNA, 39 bp, Artificial Sequence
  Synthetic
ggagtgaccggctggcggctgaagaagcgccggagccgg

SEQ ID NO: 242 - protein, 13 aa, Artificial Sequence
  Synthetic
GVTGWRLKKRRSR

SEQ ID NO: 243 - DNA, 39 bp, Artificial Sequence
  Synthetic
aacgtgaccggctggcggctgtgcaagcgcattagcgcg

SEQ ID NO: 244 - protein, 13 aa, Artificial Sequence
  Synthetic
NVTGWRLCKRISA

SEQ ID NO: 245 - DNA, 39 bp, Artificial Sequence
  Synthetic
agcgtgaccggctggcggctgtgcaagcgcattagcgcg

SEQ ID NO: 246 - protein, 13 aa, Artificial Sequence
  Synthetic
SVTGWRLCKRISA

SEQ ID NO: 247 - DNA, 39 bp, Artificial Sequence
  Synthetic
gaggtgaccggctggcggctgtgcaagcgcattagcgcg

SEQ ID NO: 248 - protein, 13 aa, Artificial Sequence
  Synthetic
EVTGWRLCKRISA

SEQ ID NO: 249 - DNA, 39 bp, Artificial Sequence
  Synthetic
ggcgtgaccggctggcggctgtgcaagcgcattagcgcg

SEQ ID NO: 250 - protein, 13 aa, Artificial Sequence
  Synthetic
HVTGWRLCKRISA

SEQ ID NO: 251 - DNA, 39 bp, Artificial Sequence
  Synthetic
ggacacaccggctggcggctgtgcaagcgcattagcgcg

SEQ ID NO: 252 - protein, 13 aa, Artificial Sequence
  Synthetic
GITGWRLCKRISA

SEQ ID NO: 253 - DNA, 39 bp, Artificial Sequence
  Synthetic
ggagccaccggctggcggctgtgcaagcgcattagcgcg

SEQ ID NO: 254 - protein, 13 aa, Artificial Sequence
  Synthetic
GATGWRLCKRISA

SEQ ID NO: 255 - DNA, 39 bp, Artificial Sequence
  Synthetic
ggaaagaccggctggcggctgtgcaagcgcattagcgcg

SEQ ID NO: 256 - protein, 13 aa, Artificial Sequence
  Synthetic
GKTGWRLCKRISA

SEQ ID NO: 257 - DNA, 39 bp, Artificial Sequence
  Synthetic
ggacagaccggctggcggctgtgcaagcgcattagcgcg

SEQ ID NO: 258 - protein, 13 aa, Artificial Sequence
  Synthetic
GQTGWRLCKRISA

SEQ ID NO: 259 - DNA, 39 bp, Artificial Sequence
  Synthetic
ggaagcaccggctggcggctgtgcaagcgcattagcgcg

SEQ ID NO: 260 - protein, 13 aa, Artificial Sequence
  Synthetic
GSTGWRLCKRISA

SEQ ID NO: 261 - DNA, 39 bp, Artificial Sequence
  Synthetic
ggagtggtgggctggcggctgtgcaagcgcattagcgcg

SEQ ID NO: 262 - protein, 13 aa, Artificial Sequence
  Synthetic
GVVGWRLCKRISA

SEQ ID NO: 263 - DNA, 39 bp, Artificial Sequence
  Synthetic
ggagtgaagggctggcggctgtgcaagcgcattagcgcg

SEQ ID NO: 264 - protein, 13 aa, Artificial Sequence
  Synthetic
GVKGWRLCKRISA

SEQ ID NO: 265 - DNA, 39 bp, Artificial Sequence
  Synthetic
ggagtgcagggctggcggctgtgcaagcgcattagcgcg

SEQ ID NO: 266 - protein, 13 aa, Artificial Sequence
  Synthetic
GVQGWRLCKRISA

SEQ ID NO: 267 - DNA, 39 bp, Artificial Sequence
  Synthetic
ggagtgaccggcacccggctgtgcaagcgcattagcgcg

SEQ ID NO: 268 - protein, 13 aa, Artificial Sequence
  Synthetic
GVTGTRLCKRISA

SEQ ID NO: 269 - DNA, 39 bp, Artificial Sequence
  Synthetic
ggagtgaccggcaagcggctgtgcaagcgcattagcgcg

SEQ ID NO: 270 - protein, 13 aa, Artificial Sequence
  Synthetic
GVTGKRLCKRISA

SEQ ID NO: 271 - DNA, 39 bp, Artificial Sequence
  Synthetic
ggagtgaccggcgtgcggctgtgcaagcgcattagcgcg

SEQ ID NO: 272 - protein, 13 aa, Artificial Sequence
  Synthetic
GVTGVRLCKRISA

SEQ ID NO: 273 - DNA, 39 bp, Artificial Sequence
  Synthetic
ggagtgaccggctggcggcactgcaagcgcattagcgcg

SEQ ID NO: 274 - protein, 13 aa, Artificial Sequence
  Synthetic
GVTGWRICKRISA

SEQ ID NO: 275 - DNA, 39 bp, Artificial Sequence
  Synthetic
ggagtgaccggctggcgggtgtgcaagcgcattagcgcg

SEQ ID NO: 276 - protein, 13 aa, Artificial Sequence
  Synthetic
GVTGWRVCKRISA

SEQ ID NO: 277 - DNA, 39 bp, Artificial Sequence
  Synthetic
ggagtgaccggctggcggacctgcaagcgcattagcgcg

SEQ ID NO: 278 - protein, 13 aa, Artificial Sequence
  Synthetic
GVTGWRTCKRISA

SEQ ID NO: 279 - DNA, 39 bp, Artificial Sequence
  Synthetic
ggagtgaccggctggcggtactgcaagcgcattagcgcg

SEQ ID NO: 280 - protein, 13 aa, Artificial Sequence
  Synthetic
GVTGWRYCKRISA

SEQ ID NO: 281 - DNA, 39 bp, Artificial Sequence
  Synthetic
ggagtgaccggctggcggaagtgcaagcgcattagcgcg

SEQ ID NO: 282 - protein, 13 aa, Artificial Sequence
  Synthetic
GVTGWRKCKRISA

SEQ ID NO: 283 - DNA, 39 bp, Artificial Sequence
  Synthetic
ggagtgaccggctggcggctgaacaagcgcattagcgcg

SEQ ID NO: 284 - protein, 13 aa, Artificial Sequence
  Synthetic
GVTGWRLNKRISA

SEQ ID NO: 285 - DNA, 39 bp, Artificial Sequence
  Synthetic
ggagtgaccggctggcggctgaccaagcgcattagcgcg

SEQ ID NO: 286 - protein, 13 aa, Artificial Sequence
  Synthetic
GVTGWRLTKRISA

SEQ ID NO: 287 - DNA, 39 bp, Artificial Sequence
  Synthetic
ggagtgaccggctggcggctgtgcaagaagattagcgcg

SEQ ID NO: 288 - protein, 13 aa, Artificial Sequence
  Synthetic
GVTGWRLCKKISA

SEQ ID NO: 289 - DNA, 39 bp, Artificial Sequence
  Synthetic
ggagtgaccggctggcggctgtgcaagaacattagcgcg

SEQ ID NO: 290 - protein, 13 aa, Artificial Sequence
  Synthetic
GVTGWRLCKNISA

SEQ ID NO: 291 - DNA, 39 bp, Artificial Sequence
  Synthetic
ggagtgaccggctggcggctgtgcaagcgcgtgagcgcg

SEQ ID NO: 292 - protein, 13 aa, Artificial Sequence
  Synthetic
GVTGWRLCKRVSA

SEQ ID NO: 293 - DNA, 39 bp, Artificial Sequence
  Synthetic
ggagtgaccggctggcggctgtgcaagcgccagagcgcg

SEQ ID NO: 294 - protein, 13 aa, Artificial Sequence
  Synthetic
GVTGWRLCKRQSA

SEQ ID NO: 295 - DNA, 39 bp, Artificial Sequence
  Synthetic
ggagtgaccggctggcggctgtgcaagcgcgagagcgcg

SEQ ID NO: 296 - protein, 13 aa, Artificial Sequence
  Synthetic
GVTGWRLCKRESA

SEQ ID NO: 297 - DNA, 39 bp, Artificial Sequence
  Synthetic
ggagtgaccggctggcggctgtgcaagcgccggagcgcg

SEQ ID NO: 298 - protein, 13 aa, Artificial Sequence
  Synthetic
GVTGWRLCKRRSA

SEQ ID NO: 299 - DNA, 39 bp, Artificial Sequence
  Synthetic
ggagtgaccggctggcggctgtgcaagcgcttcagcgcg

SEQ ID NO: 300 - protein, 13 aa, Artificial Sequence
  Synthetic
GVTGWRLCKRFSA

SEQ ID NO: 301 - DNA, 39 bp, Artificial Sequence
  Synthetic
ggagtgaccggctggcggctgtgcaagcgcattagcaac

SEQ ID NO: 302 - protein, 13 aa, Artificial Sequence
  Synthetic
GVTGWRLCKRISN

SEQ ID NO: 303 - DNA, 39 bp, Artificial Sequence
  Synthetic
ggagtgaccggctggcggctgtgcaagcgcattagcacc

SEQ ID NO: 304 - protein, 13 aa, Artificial Sequence
  Synthetic
GVTGWRLCKRIST

SEQ ID NO: 305 - DNA, 39 bp, Artificial Sequence
  Synthetic
ggagtgaccggctggcggctgtgcaagcgcattagccgg

SEQ ID NO: 306 - protein, 13 aa, Artificial Sequence
  Synthetic
GVTGWRLCKRISR

SEQ ID NO: 307 - DNA, 39 bp, Artificial Sequence
  Synthetic
ggagtgaccggctggcggctgtgcaagcgcattagcctg

SEQ ID NO: 308 - protein, 13 aa, Artificial Sequence
  Synthetic
GVTGWRLCKRISL

SEQ ID NO: 309 - DNA, 39 bp, Artificial Sequence
  Synthetic
ggagtgaccggctggcggctgtgcaagcgcattagcgag

SEQ ID NO: 310 - protein, 13 aa, Artificial Sequence
  Synthetic
GVTGWRLCKRISE

SEQ ID NO: 311 - DNA, 39 bp, Artificial Sequence
  Synthetic
ggagtgaccggcttccggctgtgcaagcgcattagcgcg

SEQ ID NO: 312 - protein, 13 aa, Artificial Sequence
  Synthetic
GVTGFRLCKRISA

SEQ ID NO: 313 - DNA, 39 bp, Artificial Sequence
  Synthetic
ggagtgaccggctaccggctgtgcaagcgcattagcgcg

SEQ ID NO: 314 - protein, 13 aa, Artificial Sequence
  Synthetic
GVTGYRLCKRISA

SEQ ID NO: 315 - DNA, 39 bp, Artificial Sequence
  Synthetic
ggagtgaccggcgagcggctgtgcaagcgcattagcgcg

SEQ ID NO: 316 - protein, 13 aa, Artificial Sequence
  Synthetic
GVTGERLCKRISA

SEQ ID NO: 317 - DNA, 39 bp, Artificial Sequence
  Synthetic
caggtgaccggctggcggctgtgcaagcgcattagcgcg

SEQ ID NO: 318 - protein, 13 aa, Artificial Sequence
  Synthetic
QVTGWRLCKRISA

SEQ ID NO: 319 - DNA, 39 bp, Artificial Sequence
  Synthetic
accgtgaccggctggcggctgtgcaagcgcattagcgcg

SEQ ID NO: 320 - protein, 13 aa, Artificial Sequence
  Synthetic
TVTGWRLCKRISA

SEQ ID NO: 321 - DNA, 39 bp, Artificial Sequence
  Synthetic
ggagtggagggctggcggctgtgcaagcgcattagcgcg

SEQ ID NO: 322 - protein, 13 aa, Artificial Sequence
  Synthetic
GVEGWRLCKRISA

SEQ ID NO: 323 - DNA, 39 bp, Artificial Sequence
  Synthetic
ggagtgaccggctggcggctgttcaagcgcattagcgcg

SEQ ID NO: 324 - protein, 13 aa, Artificial Sequence
  Synthetic
GVTGWRLFKRISA

SEQ ID NO: 325 - DNA, 39 bp, Artificial Sequence
  Synthetic
ggagtgaccggctggcggctgtacaagcgcattagcgcg

SEQ ID NO: 326 - protein, 13 aa, Artificial Sequence
  Synthetic
GVTGWRLYKRISA

SEQ ID NO: 327 - DNA, 39 bp, Artificial Sequence
  Synthetic
ggagtgaccggctggcggctgagcaagcgcattagcgcg

SEQ ID NO: 328 - protein, 13 aa, Artificial Sequence
  Synthetic
GVTGWRLSKRISA

SEQ ID NO: 329 - DNA, 39 bp, Artificial Sequence
  Synthetic
ggagtgaccggctggcggctgggcaagcgcattagcgcg

SEQ ID NO: 330 - protein, 13 aa, Artificial Sequence
  Synthetic
GVTGWRLHKRISA

SEQ ID NO: 331 - DNA, 39 bp, Artificial Sequence
  Synthetic
ggagtgaccggctggcggctgatgaagcgcattagcgcg

SEQ ID NO: 332 - protein, 13 aa, Artificial Sequence
  Synthetic
GVTGWRLMKRISA

SEQ ID NO: 333 - DNA, 39 bp, Artificial Sequence
  Synthetic
ggagtgaccggctggcggctggccaagcgcattagcgcg

SEQ ID NO: 334 - protein, 13 aa, Artificial Sequence
  Synthetic
GVTGWRLAKRISA

SEQ ID NO: 335 - DNA, 39 bp, Artificial Sequence
  Synthetic
ggagtgaccggctggcggctgcagaagcgcattagcgcg

SEQ ID NO: 336 - protein, 13 aa, Artificial Sequence
  Synthetic
GVTGWRLQKRISA

SEQ ID NO: 337 - DNA, 39 bp, Artificial Sequence
  Synthetic
ggagtgaccggctggcggctgctgaagcgcattagcgcg

SEQ ID NO: 338 - protein, 13 aa, Artificial Sequence
  Synthetic
GVTGWRLLKRISA

SEQ ID NO: 339 - DNA, 39 bp, Artificial Sequence
  Synthetic
ggagtgaccggctggcggctgaagaagcgcattagcgcg

SEQ ID NO: 340 - protein, 13 aa, Artificial Sequence
  Synthetic
GVTGWRLKKRISA

SEQ ID NO: 341 - DNA, 39 bp, Artificial Sequence
  Synthetic
aaccacaccggctggcggctgaacaagaaggtgagcaac

SEQ ID NO: 342 - protein, 13 aa, Artificial Sequence
  Synthetic
NITGWRLNKKVSN

SEQ ID NO: 343 - DNA, 39 bp, Artificial Sequence
  Synthetic
aaccacaccggctaccggctgaacaagaaggtgagcaac

SEQ ID NO: 344 - protein, 13 aa, Artificial Sequence
  Synthetic
NITGYRLNKKVSN

SEQ ID NO: 345 - DNA, 39 bp, Artificial Sequence
  Synthetic
tgcgtgaccggctggcggctgttcaagcgcattagcgcg

SEQ ID NO: 346 - protein, 13 aa, Artificial Sequence
  Synthetic
CVTGWRLFKRISA

SEQ ID NO: 347 - DNA, 39 bp, Artificial Sequence
  Synthetic
cccgtgaccggctggcggctgttcaagcgcattagcgcg

SEQ ID NO: 348 - protein, 13 aa, Artificial Sequence
  Synthetic
PVTGWRLFKRISA

SEQ ID NO: 349 - DNA, 39 bp, Artificial Sequence
  Synthetic
aaccacaccggctaccggctgttcaagaaggtgagcaac

SEQ ID NO: 350 - protein, 13 aa, Artificial Sequence
  Synthetic
NITGYRLFKKVSN

SEQ ID NO: 351 - DNA, 39 bp, Artificial Sequence
  Synthetic
aacgtgaccggctaccggctgttcaagaaggtgagcaac

SEQ ID NO: 352 - protein, 13 aa, Artificial Sequence
  Synthetic
NVTGYRLFKKVSN

SEQ ID NO: 353 - DNA, 39 bp, Artificial Sequence
  Synthetic
aacgtgaccggctggcggctgttcaagaaggtgagcaac

SEQ ID NO: 354 - protein, 13 aa, Artificial Sequence
  Synthetic
NVTGWRLFKKVSN

SEQ ID NO: 355 - DNA, 39 bp, Artificial Sequence
  Synthetic
aacgtgaccggctggcggctgttcaagaagattagcaac

SEQ ID NO: 356 - protein, 13 aa, Artificial Sequence
  Synthetic
NVTGWRLFKKISN

SEQ ID NO: 357 - DNA, 39 bp, Artificial Sequence
  Synthetic
aacgtgaccggctggcggctgttcaagcgcattagcaac

SEQ ID NO: 358 - protein, 13 aa, Artificial Sequence
  Synthetic
NVTGWRLFKRISN

SEQ ID NO: 359 - DNA, 39 bp, Artificial Sequence
  Synthetic
ggagtgaccggctggcggctgttcaagcgcattagcaac

SEQ ID NO: 360 - protein, 13 aa, Artificial Sequence
  Synthetic
GVTGWRLFKRISN

SEQ ID NO: 361 - DNA, 39 bp, Artificial Sequence
  Synthetic
aacgtgaccggctggcggctgttcgaacgcattagcaac

SEQ ID NO: 362 - protein, 13 aa, Artificial Sequence
  Synthetic
NVTGWRLFERISN

SEQ ID NO: 363 - DNA, 39 bp, Artificial Sequence
  Synthetic
aacgtgaccggctggcggctgttcaagcgcattctgaac

SEQ ID NO: 364 - protein, 13 aa, Artificial Sequence
  Synthetic
NVTGWRLFKRILN

SEQ ID NO: 365 - DNA, 39 bp, Artificial Sequence
  Synthetic
aacgtgaccggctggcggctgttcaagcgcattagcgcg

SEQ ID NO: 366 - protein, 13 aa, Artificial Sequence
  Synthetic
NVTGWRLFKRISA

SEQ ID NO: 367 - DNA, 39 bp, Artificial Sequence
  Synthetic
aacgtgaccggctggcggctgttcgaaaagattagcaac

SEQ ID NO: 368 - protein, 13 aa, Artificial Sequence
  Synthetic
NVTGWRLFEKISN

SEQ ID NO: 369 - DNA, 39 bp, Artificial Sequence
  Synthetic
aacgtgagcggctggcggctgttcgaaaagattagcaac

SEQ ID NO: 370 - protein, 13 aa, Artificial Sequence
  Synthetic
NVSGWRLFEKISN

SEQ ID NO: 371 - DNA, 36 bp, Artificial Sequence
  Synthetic
gtgaccggctggcggctgttcaagaagattagcaac

SEQ ID NO: 372 - protein, 12 aa, Artificial Sequence
  Synthetic
VTGWRLFKKISN

SEQ ID NO: 373 - DNA, 39 bp, Artificial Sequence
  Synthetic
aacgtgagcggctggcggctgttcaagaagattagcaac

SEQ ID NO: 374 - protein, 13 aa, Artificial Sequence
  Synthetic
NVSGWRLFKKISN

SEQ ID NO: 375 - DNA, 39 bp, Artificial Sequence
  Synthetic
aacgtgaccggctaccggctgttcaagaagattagcaac

SEQ ID NO: 376 - protein, 13 aa, Artificial Sequence
  Synthetic
NVTGYRLFKKISN

SEQ ID NO: 377 - DNA, 36 bp, Artificial Sequence
  Synthetic
gtgagcggctggcggctgttcaagaagattagcaac

SEQ ID NO: 378 - protein, 12 aa, Artificial Sequence
  Synthetic
VSGWRLFKKISN

SEQ ID NO: 379 - DNA, 33 bp, Artificial Sequence
  Synthetic
agcggctggcggctgttcaagaagattagcaac

SEQ ID NO: 380 - protein, 11 aa, Artificial Sequence
  Synthetic
SGWRLFKKISN

SEQ ID NO: 381 - DNA, 30 bp, Artificial Sequence
  Synthetic
ggctggcggctgttcaagaagattagcaac

SEQ ID NO: 382 - protein, 10 aa, Artificial Sequence
  Synthetic
GWRLFKKISN

SEQ ID NO: 383 - DNA, 36 bp, Artificial Sequence
  Synthetic
aacgtgagcggctggcggctgttcaagaagattagc

SEQ ID NO: 384 - protein, 12 aa, Artificial Sequence
  Synthetic
NVSGWRLFKKIS

SEQ ID NO: 385 - DNA, 33 bp, Artificial Sequence
  Synthetic
aacgtgagcggctggcggctgttcaagaagatt

SEQ ID NO: 386 - protein, 11 aa, Artificial Sequence
  Synthetic
NVSGWRLFKKI

SEQ ID NO: 387 - DNA, 30 bp, Artificial Sequence
  Synthetic
aacgtgagcggctggcggctgttcaagaag

SEQ ID NO: 388 - protein, 10 aa, Artificial Sequence
  Synthetic
NVSGWRLFKK

SEQ ID NO: 389 - DNA, 33 bp, Artificial Sequence
  Synthetic
gtgagcggctggcggctgttcaagaagattagc

SEQ ID NO: 390 - protein, 11 aa, Artificial Sequence
  Synthetic
VSGWRLFKKIS

SEQ ID NO: 391 - DNA, 27 bp, Artificial Sequence
  Synthetic
agcggctggcggctgttcaagaagatt

SEQ ID NO: 392 - protein, 9 aa, Artificial Sequence
  Synthetic
SGWRLFKKI

SEQ ID NO: 393 - DNA, 39 bp, Artificial Sequence
  Synthetic
aacgtgagcggctggggcctgttcaagaagattagcaac

SEQ ID NO: 394 - protein, 13 aa, Artificial Sequence
  Synthetic
NVSGWGLFKKISN

SEQ ID NO: 395 - DNA, 39 bp, Artificial Sequence
  Synthetic
cccgtgagcggctggcggctgttcaagaagattagcaac

SEQ ID NO: 396 - protein, 13 aa, Artificial Sequence
  Synthetic
PVSGWRLFKKISN

SEQ ID NO: 397 - DNA, 42 bp, Artificial Sequence
  Synthetic
aaccccgtgagcggctggcggctgttcaagaagattagcaac

SEQ ID NO: 398 - protein, 14 aa, Artificial Sequence
  Synthetic
NPVSGWRLFKKISN

SEQ ID NO: 399 - DNA, 45 bp, Artificial Sequence
  Synthetic
atcaaccccgtgagcggctggcggctgttcaagaagattagcaac

SEQ ID NO: 400 - protein, 15 aa, Artificial Sequence
  Synthetic
INPVSGWRLFKKISN

SEQ ID NO: 401 - DNA, 48 bp, Artificial Sequence
  Synthetic
accatcaaccccgtgagcggctggcggctgttcaagaagattagcaac

SEQ ID NO: 402 - protein, 16 aa, Artificial Sequence
  Synthetic
TINPVSGWRLFKKISN

SEQ ID NO: 403 - DNA, 51 bp, Artificial Sequence
  Synthetic
gtgaccatcaaccccgtgagcggctggcggctgttcaagaagattagcaac

SEQ ID NO: 404 - protein, 17 aa, Artificial Sequence
  Synthetic
VTINPVSGWRLFKKISN

SEQ ID NO: 405 - DNA, 54 bp, Artificial Sequence
  Synthetic
cgggtgaccatcaaccccgtgagcggctggcggctgttcaagaagattagcaac

SEQ ID NO: 406 - protein, 18 aa, Artificial Sequence
  Synthetic
RVTINPVSGWRLFKKISN

SEQ ID NO: 407 - DNA, 27 bp, Artificial Sequence
  Synthetic
agcggctggcggctgctgaagaagatt

SEQ ID NO: 408 - protein, 9 aa, Artificial Sequence
  Synthetic
SGWRLLKKI

SEQ ID NO: 409 - DNA, 27 bp, Artificial Sequence
  Synthetic
accggctaccggctgctgaagaagatt

SEQ ID NO: 410 - protein, 9 aa, Artificial Sequence
  Synthetic
TGYRLLKKI

SEQ ID NO: 411 - DNA, 24 bp, Artificial Sequence
  Synthetic
agcggctggcggctgttcaagaag

SEQ ID NO: 412 - protein, 8 aa, Artificial Sequence
  Synthetic
SGWRLFKK

SEQ ID NO: 413 - DNA, 33 bp, Artificial Sequence
  Synthetic
gtgaccggctaccggctgttcaagaagattagc

SEQ ID NO: 414 - protein, 11 aa, Artificial Sequence
  Synthetic
VTGYRLFKKIS

SEQ ID NO: 415 - DNA, 33 bp, Artificial Sequence
  Synthetic
gtgaccggctaccggctgttcgagaagattagc

SEQ ID NO: 416 - protein, 11 aa, Artificial Sequence
  Synthetic
VTGYRLFEKIS

SEQ ID NO: 417 - DNA, 33 bp, Artificial Sequence
  Synthetic
gtgaccggctaccggctgttcgagcagattagc

SEQ ID NO: 418 - protein, 11 aa, Artificial Sequence
  Synthetic
VTGYRLFEQIS

SEQ ID NO: 419 - DNA, 33 bp, Artificial Sequence
  Synthetic
gtgaccggctaccggctgttcgagaaggagagc

SEQ ID NO: 420 - protein, 11 aa, Artificial Sequence
  Synthetic
VTGYRLFEKES

SEQ ID NO: 421 - DNA, 33 bp, Artificial Sequence
  Synthetic
gtgaccggctaccggctgttcgagcaggagagc

SEQ ID NO: 422 - protein, 11 aa, Artificial Sequence
  Synthetic
VTGYRLFEQES

SEQ ID NO: 423 - DNA, 33 bp, Artificial Sequence
  Synthetic
gtgaccggctaccggctgttcgagcaggagctg

SEQ ID NO: 424 - protein, 11 aa, Artificial Sequence
  Synthetic
VTGYRLFEQEL

SEQ ID NO: 425 - DNA, 33 bp, Artificial Sequence
  Synthetic
gtggagggctaccggctgttcgagaagattagc

SEQ ID NO: 426 - protein, 11 aa, Artificial Sequence
  Synthetic
VEGYRLFEKIS

SEQ ID NO: 427 - DNA, 33 bp, Artificial Sequence
  Synthetic
gtggagggctaccggctgttcgagcagattagc

SEQ ID NO: 428 - protein, 11 aa, Artificial Sequence
  Synthetic
VEGYRLFEQIS

SEQ ID NO: 429 - DNA, 33 bp, Artificial Sequence
  Synthetic
gtggagggctaccggctgttcgagaaggagagc

SEQ ID NO: 430 - protein, 11 aa, Artificial Sequence
  Synthetic
VEGYRLFEKES

SEQ ID NO: 431 - DNA, 33 bp, Artificial Sequence
  Synthetic
gtggagggctaccggctgttcgagcaggagagc

SEQ ID NO: 432 - protein, 11 aa, Artificial Sequence
  Synthetic
VEGYRLFEQES

SEQ ID NO: 433 - DNA, 33 bp, Artificial Sequence
  Synthetic
gtggagggctaccggctgttcgagcaggagctg

SEQ ID NO: 434 - protein, 11 aa, Artificial Sequence
  Synthetic
VEGYRLFEQEL

SEQ ID NO: 435 - DNA, 33 bp, Artificial Sequence
  Synthetic
attagcggctggcggctgatgaagaacattagc

SEQ ID NO: 436 - protein, 11 aa, Artificial Sequence
  Synthetic
ISGWRLMKNIS

SEQ ID NO: 437 - DNA, 33 bp, Artificial Sequence
  Synthetic
gtggagggctaccggctgttcaagaagattagc

SEQ ID NO: 438 - protein, 11 aa, Artificial Sequence
  Synthetic
VEGYRLFKKIS

SEQ ID NO: 439 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 440 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 441 - DNA, 477 bp, Artificial Sequence
  Synthetic
atggtcttcacactcgaagatttcgttggggactggcaacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 442 - protein, 159 aa, Artificial Sequence
  Synthetic
MVFTLEDFVGDWNQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 443 - DNA, 477 bp, Artificial Sequence
  Synthetic
atggtcttcacactcgaagatttcgttggggactggcgacagatcgccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 444 - protein, 159 aa, Artificial Sequence
  Synthetic
MVFTLEDFVGDWRQIAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 445 - DNA, 477 bp, Artificial Sequence
  Synthetic
atggtcttcacactcgaagatttcgttggggactggcgacagacagccagctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 446 - protein, 159 aa, Artificial Sequence
  Synthetic
MVFTLEDFVGDWRQTASYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 447 - DNA, 477 bp, Artificial Sequence
  Synthetic
atggtcttcacactcgaagatttcgttggggactggcgacagacagccggctacaaccaggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 448 - protein, 159 aa, Artificial Sequence
  Synthetic
MVFTLEDFVGDWRQTAGYNQDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 449 - DNA, 477 bp, Artificial Sequence
  Synthetic
atggtcttcacactcgaagatttcgttggggactggcgacagacagccggctacaacctggacaaggtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 450 - protein, 159 aa, Artificial Sequence
  Synthetic
MVFTLEDFVGDWRQTAGYNLDKVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 451 - DNA, 477 bp, Artificial Sequence
  Synthetic
atggtcttcacactcgaagatttcgttggggactggcgacagacagccggctacaacctggaccaagtccttgaacagggaggtatgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 452 - protein, 159 aa, Artificial Sequence
  Synthetic
MVFTLEDFVGDWRQTAGYNLDQVLEQGGMSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 453 - DNA, 477 bp, Artificial Sequence
  Synthetic
atggtcttcacactcgaagatttcgttggggactggcgacagacagccggctacaacctggaccaagtccttgaacagggaggtgtgtccagtttgatacagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 454 - protein, 159 aa, Artificial Sequence
  Synthetic
MVFTLEDFVGDWRQTAGYNLDQVLEQGGVSSLIQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 455 - DNA, 477 bp, Artificial Sequence
  Synthetic
atggtcttcacactcgaagatttcgttggggactggcgacagacagccggctacaacctggaccaagtccttgaacagggaggtgtgtccagtttgttgcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 456 - protein, 159 aa, Artificial Sequence
  Synthetic
MVFTLEDFVGDWRQTAGYNLDQVLEQGGVSSLLQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 457 - DNA, 477 bp, Artificial Sequence
  Synthetic
atggtcttcacactcgaagatttcgttggggactggcgacagacagccggctacaacctggaccaagtccttgaacagggaggtgtgtccagtttggttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 458 - protein, 159 aa, Artificial Sequence
  Synthetic
MVFTLEDFVGDWRQTAGYNLDQVLEQGGVSSLVQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 459 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcggaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 460 - protein, 159 aa, Artificial Sequence
  Synthetic
MVFTLEDFVGDWRQTAGYNLDQVLEQGGVSSLFRNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 461 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaaactcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 462 - protein, 159 aa, Artificial Sequence
  Synthetic
MVFTLEDFVGDWRQTAGYNLDQVLEQGGVSSLFQKLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 463 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagcggctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 464 - protein, 159 aa, Artificial Sequence
  Synthetic
MVFTLEDFVGDWRQTAGYNLDQVLEQGGVSSLFQRLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 465 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacaaccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 466 - protein, 159 aa, Artificial Sequence
  Synthetic
MVFTLEDFVGDWRQTAGYNLDQVLEQGGVSSLFQNLGVSVTPIQRIVLSGENGLKIDNHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 467 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgccatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 468 - protein, 159 aa, Artificial Sequence
  Synthetic
MVFTLEDFVGDWRQTAGYNLDQVLEQGGVSSLFQNLGVSVTPIQRIVLSGENGLKIDIHAIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 469 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcaccatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 470 - protein, 159 aa, Artificial Sequence
  Synthetic
MVFTLEDFVGDWRQTAGYNLDQVLEQGGVSSLFQNLGVSVTPIQRIVLSGENGLKIDIHVTIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 471 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcagcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 472 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSSDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 473 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgacgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 474 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSDDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 475 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 476 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 477 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 478 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 479 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacattatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 480 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 481 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 482 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 483 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacagccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 484 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGQPYEGIAVFDGKKITVTGTLWNGNKIIDERLINPDGSLLFRVTINV

SEQ ID NO: 485 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 486 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 487 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 488 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 489 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcgacgtt

SEQ ID NO: 490 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIDV

SEQ ID NO: 491 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcagcgtt

SEQ ID NO: 492 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTISV

SEQ ID NO: 493 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgat

SEQ ID NO: 494 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 495 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 496 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 497 - DNA, 477 bp, Artificial Sequence
  Synthetic
atggtcttcacactcgaagatttcgttgccgactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 498 - protein, 159 aa, Artificial Sequence
  Synthetic
MVFTLEDFVADWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 499 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 500 - protein, 159 aa, Artificial Sequence
  Synthetic
MVFTLEDFVGDWRQTAAYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 501 - DNA, 477 bp, Artificial Sequence
  Synthetic
atggtcttcacactcgaagatttcgttggggactggcgacagacagccggctacaacctggaccaagtccttgaacaggccggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 502 - protein, 159 aa, Artificial Sequence
  Synthetic
MVFTLEDFVGDWRQTAGYNLDQVLEQAGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 503 - DNA, 477 bp, Artificial Sequence
  Synthetic
atggtcttcacactcgaagatttcgttggggactggcgacagacagccggctacaacctggaccaagtccttgaacagggagccgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 504 - protein, 159 aa, Artificial Sequence
  Synthetic
MVFTLEDFVGDWRQTAGYNLDQVLEQGAVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 505 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 506 - protein, 159 aa, Artificial Sequence
  Synthetic
MVFTLEDFVGDWRQTAGYNLDQVLEQGGVSSLFQNLAVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 507 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcgccgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 508 - protein, 159 aa, Artificial Sequence
  Synthetic
MVFTLEDFVGDWRQTAGYNLDQVLEQGGVSSLFQNLGVSVTPIQRIVLSAENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 509 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 510 - protein, 159 aa, Artificial Sequence
  Synthetic
MVFTLEDFVGDWRQTAGYNLDQVLEQGGVSSLFQNLGVSVTPIQRIVLSGENALKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 511 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaagccctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 512 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEALSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 513 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 514 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 515 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 516 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 517 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatgccacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 518 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYATLVIDGVTPNMIDYFGRPYEGIAVFDGKKITVTGTLWNGNKIIDERLINPDGSLLFRVTINV

SEQ ID NO: 519 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacgccgttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 520 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDAVTPNMIDYFGRPYEGIAVFDGKKITVTGTLWNGNKIIDERLINPDGSLLFRVTINV

SEQ ID NO: 521 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcgcccggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 522 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFARPYEGIAVFDGKKITVTGTLWNGNKIIDERLINPDGSLLFRVTINV

SEQ ID NO: 523 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaagccatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 524 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEAIAVFDGKKITVTGTLWNGNKIIDERLINPDGSLLFRVTINV

SEQ ID NO: 525 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacgccaaaaagatcactgtaacagggaccctgtggaacggcaacaaaattatcgacgagcgcctgatcaaccccgacggctccctgctgttccgagtaaccatcaacgtt

SEQ ID NO: 526 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDAKKITVTGTLWNGNKIIDERLINPDGSLLFRVTINV

SEQ ID NO: 527 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagccaccctgtggaacggcaacaaaattatcgacgagcgcctgatcaaccccgacggctccctgctgttccgagtaaccatcaacgtt

SEQ ID NO: 528 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTATLWNGNKIIDERLINPDGSLLFRVTINV

SEQ ID NO: 529 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacgccaacaaaattatcgacgagcgcctgatcaaccccgacggctccctgctgttccgagtaaccatcaacgtt

SEQ ID NO: 530 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNANKIIDERLINPDGSLLFRVTINV

SEQ ID NO: 531 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacgcctccctgctgttccgagtaaccatcaacgtt

SEQ ID NO: 532 - protein, 159 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDASLLFRVTINV

SEQ ID NO: 533 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaaggccgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 534 - protein, 159 aa, Artificial Sequence
  Synthetic
MVFTLEDFVGDWRQTAGYNLDQVLEQGGVSSLFQNLGVSVTPIQRIVLSGENGLKADIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 535 - DNA, 477 bp, Artificial Sequence
  Synthetic
atggtcttcacactcgaagatttcgttggggactggcgacagacagccgcctacaacctggcccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 536 - protein, 159 aa, Artificial Sequence
  Synthetic
MVFTLEDFVGDWRQTAAYNLAQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 537 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 538 - protein, 159 aa, Artificial Sequence
  Synthetic
MVFTLEDFVGDWRQTAAYNLDQVLEQGGVSSLFQNLAVSVTPIQRIVLSGENGLKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 539 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 540 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 541 - DNA, 477 bp, Artificial Sequence
  Synthetic
atggtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 542 - protein, 159 aa, Artificial Sequence
  Synthetic
MVFTLEDFVGDWRQTAGYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 543 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 544 - protein, 159 aa, Artificial Sequence
  Synthetic
MVFTLEDFVGDWRQTAAYNLDQVLEQGGVSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 545 - DNA, 477 bp, Artificial Sequence; identical to SEQ ID NO: 537
  Synthetic

SEQ ID NO: 546 - protein, 159 aa, Artificial Sequence; identical to SEQ ID NO: 538
  Synthetic

SEQ ID NO: 547 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 548 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 549 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 550 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 551 - DNA, 477 bp, Artificial Sequence
  Synthetic
atggtcttcacactcgaagatttcgttggggactgggcccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 552 - protein, 159 aa, Artificial Sequence
  Synthetic
MVFTLEDFVGDWAQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 553 - DNA, 477 bp, Artificial Sequence
  Synthetic
atggtcttcacactcgaagatttcgttggggactggtgccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 554 - protein, 159 aa, Artificial Sequence
  Synthetic
MVFTLEDFVGDWCQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 555 - DNA, 477 bp, Artificial Sequence
  Synthetic
atggtcttcacactcgaagatttcgttggggactgggaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 556 - protein, 159 aa, Artificial Sequence
  Synthetic
MVFTLEDFVGDWDQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 557 - DNA, 477 bp, Artificial Sequence
  Synthetic
atggtcttcacactcgaagatttcgttggggactgggagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 558 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 559 - DNA, 477 bp, Artificial Sequence
  Synthetic
atggtcttcacactcgaagatttcgttggggactggttccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 560 - protein, 159 aa, Artificial Sequence
  Synthetic
MVFTLEDFVGDWFQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 561 - DNA, 477 bp, Artificial Sequence
  Synthetic
atggtcttcacactcgaagatttcgttggggactggggccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 562 - protein, 159 aa, Artificial Sequence
  Synthetic
MVFTLEDFVGDWGQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 563 - DNA, 477 bp, Artificial Sequence
  Synthetic
atggtcttcacactcgaagatttcgttggggactggcaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 564 - protein, 159 aa, Artificial Sequence
  Synthetic
MVFTLEDFVGDWHQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 565 - DNA, 477 bp, Artificial Sequence
  Synthetic
atggtcttcacactcgaagatttcgttggggactggatccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 566 - protein, 159 aa, Artificial Sequence
  Synthetic
MVFTLEDFVGDWIQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 567 - DNA, 477 bp, Artificial Sequence
  Synthetic
atggtcttcacactcgaagatttcgttggggactggaagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 568 - protein, 159 aa, Artificial Sequence
  Synthetic
MVFTLEDFVGDWKQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 569 - DNA, 477 bp, Artificial Sequence
  Synthetic
atggtcttcacactcgaagatttcgttggggactggctgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 570 - protein, 159 aa, Artificial Sequence
  Synthetic
MVFTLEDFVGDWLQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 571 - DNA, 477 bp, Artificial Sequence
  Synthetic
atggtcttcacactcgaagatttcgttggggactggatgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 572 - protein, 159 aa, Artificial Sequence
  Synthetic
MVFTLEDFVGDWMQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 573 - DNA, 477 bp, Artificial Sequence
  Synthetic
atggtcttcacactcgaagatttcgttggggactggaaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 574 - protein, 159 aa, Artificial Sequence
  Synthetic
MVFTLEDFVGDWNQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 575 - DNA, 477 bp, Artificial Sequence
  Synthetic
atggtcttcacactcgaagatttcgttggggactggccccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 576 - protein, 159 aa, Artificial Sequence
  Synthetic
MVFTLEDFVGDWPQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 577 - DNA, 477 bp, Artificial Sequence
  Synthetic
atggtcttcacactcgaagatttcgttggggactggcagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 578 - protein, 159 aa, Artificial Sequence
  Synthetic
MVFTLEDFVGDWQQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 579 - DNA, 477 bp, Artificial Sequence
  Synthetic
atggtcttcacactcgaagatttcgttggggactggagccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 580 - protein, 159 aa, Artificial Sequence
  Synthetic
MVFTLEDFVGDWSQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 581 - DNA, 477 bp, Artificial Sequence
  Synthetic
atggtcttcacactcgaagatttcgttggggactggacccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 582 - protein, 159 aa, Artificial Sequence
  Synthetic
MVFTLEDFVGDWTQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 583 - DNA, 477 bp, Artificial Sequence
  Synthetic
atggtcttcacactcgaagatttcgttggggactgggtgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 584 - protein, 159 aa, Artificial Sequence
  Synthetic
MVFTLEDFVGDWVQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 585 - DNA, 477 bp, Artificial Sequence
  Synthetic
atggtcttcacactcgaagatttcgttggggactggtggcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 586 - protein, 159 aa, Artificial Sequence
  Synthetic
MVFTLEDFVGDWWQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 587 - DNA, 477 bp, Artificial Sequence
  Synthetic
atggtcttcacactcgaagatttcgttggggactggtaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 588 - protein, 159 aa, Artificial Sequence
  Synthetic
MVFTLEDFVGDWYQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 589 - DNA, 477 bp, Artificial Sequence
  Synthetic
atggtcttcacactcgaagatttcgttggggactggcgacagacagcctgctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 590 - protein, 159 aa, Artificial Sequence
  Synthetic
MVFTLEDFVGDWRQTACYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 591 - DNA, 477 bp, Artificial Sequence
  Synthetic
atggtcttcacactcgaagatttcgttggggactggcgacagacagccgactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 592 - protein, 159 aa, Artificial Sequence
  Synthetic
MVFTLEDFVGDWRQTADYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 593 - DNA, 477 bp, Artificial Sequence
  Synthetic
atggtcttcacactcgaagatttcgttggggactggcgacagacagccgagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 594 - protein, 159 aa, Artificial Sequence
  Synthetic
MVFTLEDFVGDWRQTAEYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 595 - DNA, 477 bp, Artificial Sequence
  Synthetic
atggtcttcacactcgaagatttcgttggggactggcgacagacagccttctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 596 - protein, 159 aa, Artificial Sequence
  Synthetic
MVFTLEDFVGDWRQTAFYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 597 - DNA, 477 bp, Artificial Sequence; identical to SEQ ID NO: 541
  Synthetic

SEQ ID NO: 598 - protein, 159 aa, Artificial Sequence; identical to SEQ ID NO: 542
  Synthetic

SEQ ID NO: 599 - DNA, 477 bp, Artificial Sequence
  Synthetic
atggtcttcacactcgaagatttcgttggggactggcgacagacagcccactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 600 - protein, 159 aa, Artificial Sequence
  Synthetic
MVFTLEDFVGDWRQTAHYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 601 - DNA, 477 bp, Artificial Sequence
  Synthetic
atggtcttcacactcgaagatttcgttggggactggcgacagacagccatctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 602 - protein, 159 aa, Artificial Sequence
  Synthetic
MVFTLEDFVGDWRQTAIYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 603 - DNA, 477 bp, Artificial Sequence
  Synthetic
atggtcttcacactcgaagatttcgttggggactggcgacagacagccaagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 604 - protein, 159 aa, Artificial Sequence
  Synthetic
MVFTLEDFVGDWRQTAKYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 605 - DNA, 477 bp, Artificial Sequence
  Synthetic
atggtcttcacactcgaagatttcgttggggactggcgacagacagccctgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 606 - protein, 159 aa, Artificial Sequence
  Synthetic
MVFTLEDFVGDWRQTALYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 607 - DNA, 477 bp, Artificial Sequence
  Synthetic
atggtcttcacactcgaagatttcgttggggactggcgacagacagccatgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 608 - protein, 159 aa, Artificial Sequence
  Synthetic
MVFTLEDFVGDWRQTAMYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 609 - DNA, 477 bp, Artificial Sequence
  Synthetic
atggtcttcacactcgaagatttcgttggggactggcgacagacagccaactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 610 - protein, 159 aa, Artificial Sequence
  Synthetic
MVFTLEDFVGDWRQTANYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 611 - DNA, 477 bp, Artificial Sequence
  Synthetic
atggtcttcacactcgaagatttcgttggggactggcgacagacagccccctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 612 - protein, 159 aa, Artificial Sequence
  Synthetic
MVFTLEDFVGDWRQTAPYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 613 - DNA, 477 bp, Artificial Sequence
  Synthetic
atggtcttcacactcgaagatttcgttggggactggcgacagacagcccagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 614 - protein, 159 aa, Artificial Sequence
  Synthetic
MVFTLEDFVGDWRQTAQYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 615 - DNA, 477 bp, Artificial Sequence
  Synthetic
atggtcttcacactcgaagatttcgttggggactggcgacagacagcccggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 616 - protein, 159 aa, Artificial Sequence
  Synthetic
MVFTLEDFVGDWRQTARYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 617 - DNA, 477 bp, Artificial Sequence
  Synthetic
atggtcttcacactcgaagatttcgttggggactggcgacagacagccagctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 618 - protein, 159 aa, Artificial Sequence
  Synthetic
MVFTLEDFVGDWRQTASYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 619 - DNA, 477 bp, Artificial Sequence
  Synthetic
atggtcttcacactcgaagatttcgttggggactggcgacagacagccacctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 620 - protein, 159 aa, Artificial Sequence
  Synthetic
MVFTLEDFVGDWRQTATYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 621 - DNA, 477 bp, Artificial Sequence
  Synthetic
atggtcttcacactcgaagatttcgttggggactggcgacagacagccgtgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 622 - protein, 159 aa, Artificial Sequence
  Synthetic
MVFTLEDFVGDWRQTAVYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 623 - DNA, 477 bp, Artificial Sequence
  Synthetic
atggtcttcacactcgaagatttcgttggggactggcgacagacagcctggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 624 - protein, 159 aa, Artificial Sequence
  Synthetic
MVFTLEDFVGDWRQTAWYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 625 - DNA, 477 bp, Artificial Sequence
  Synthetic
atggtcttcacactcgaagatttcgttggggactggcgacagacagcctactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 626 - protein, 159 aa, Artificial Sequence
  Synthetic
MVFTLEDFVGDWRQTAYYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 627 - DNA, 477 bp, Artificial Sequence
  Synthetic
atggtcttcacactcgaagatttcgttggggactggcgacagacagccgcctacaacgccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 628 - protein, 159 aa, Artificial Sequence
  Synthetic
MVFTLEDFVGDWRQTAAYNADQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 629 - DNA, 477 bp, Artificial Sequence
  Synthetic
atggtcttcacactcgaagatttcgttggggactggcgacagacagccgcctacaactgcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 630 - protein, 159 aa, Artificial Sequence
  Synthetic
MVFTLEDFVGDWRQTAAYNCDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 631 - DNA, 477 bp, Artificial Sequence
  Synthetic
atggtcttcacactcgaagatttcgttggggactggcgacagacagccgcctacaacgacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 632 - protein, 159 aa, Artificial Sequence
  Synthetic
MVFTLEDFVGDWRQTAAYNDDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 633 - DNA, 477 bp, Artificial Sequence
  Synthetic
atggtcttcacactcgaagatttcgttggggactggcgacagacagccgcctacaacgaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 634 - protein, 159 aa, Artificial Sequence
  Synthetic
MVFTLEDFVGDWRQTAAYNEDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 635 - DNA, 477 bp, Artificial Sequence
  Synthetic
atggtcttcacactcgaagatttcgttggggactggcgacagacagccgcctacaacttcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 636 - protein, 159 aa, Artificial Sequence
  Synthetic
MVFTLEDFVGDWRQTAAYNFDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 637 - DNA, 477 bp, Artificial Sequence
  Synthetic
atggtcttcacactcgaagatttcgttggggactggcgacagacagccgcctacaacggcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 638 - protein, 159 aa, Artificial Sequence
  Synthetic
MVFTLEDFVGDWRQTAAYNGDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 639 - DNA, 477 bp, Artificial Sequence
  Synthetic
atggtcttcacactcgaagatttcgttggggactggcgacagacagccgcctacaaccacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 640 - protein, 159 aa, Artificial Sequence
  Synthetic
MVFTLEDFVGDWRQTAAYNHDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 641 - DNA, 477 bp, Artificial Sequence
  Synthetic
atggtcttcacactcgaagatttcgttggggactggcgacagacagccgcctacaacatcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 642 - protein, 159 aa, Artificial Sequence
  Synthetic
MVFTLEDFVGDWRQTAAYNIDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 643 - DNA, 477 bp, Artificial Sequence
  Synthetic
atggtcttcacactcgaagatttcgttggggactggcgacagacagccgcctacaacaaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 644 - protein, 159 aa, Artificial Sequence
  Synthetic
MVFTLEDFVGDWRQTAAYNKDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 645 - DNA, 477 bp, Artificial Sequence
  Synthetic
atggtcttcacactcgaagatttcgttggggactggcgacagacagccgcctacaacatggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 646 - protein, 159 aa, Artificial Sequence
  Synthetic
MVFTLEDFVGDWRQTAAYNMDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 647 - DNA, 477 bp, Artificial Sequence
  Synthetic
atggtcttcacactcgaagatttcgttggggactggcgacagacagccgcctacaacaacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 648 - protein, 159 aa, Artificial Sequence
  Synthetic
MVFTLEDFVGDWRQTAAYNNDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 649 - DNA, 477 bp, Artificial Sequence
  Synthetic
atggtcttcacactcgaagatttcgttggggactggcgacagacagccgcctacaaccccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 650 - protein, 159 aa, Artificial Sequence
  Synthetic
MVFTLEDFVGDWRQTAAYNPDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 651 - DNA, 477 bp, Artificial Sequence
  Synthetic
atggtcttcacactcgaagatttcgttggggactggcgacagacagccgcctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 652 - protein, 159 aa, Artificial Sequence
  Synthetic
MVFTLEDFVGDWRQTAAYNQDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 653 - DNA, 477 bp, Artificial Sequence
  Synthetic
atggtcttcacactcgaagatttcgttggggactggcgacagacagccgcctacaaccgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 654 - protein, 159 aa, Artificial Sequence
  Synthetic
MVFTLEDFVGDWRQTAAYNRDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 655 - DNA, 477 bp, Artificial Sequence
  Synthetic
atggtcttcacactcgaagatttcgttggggactggcgacagacagccgcctacaacagcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 656 - protein, 159 aa, Artificial Sequence
  Synthetic
MVFTLEDFVGDWRQTAAYNSDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 657 - DNA, 477 bp, Artificial Sequence
  Synthetic
atggtcttcacactcgaagatttcgttggggactggcgacagacagccgcctacaacaccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 658 - protein, 159 aa, Artificial Sequence
  Synthetic
MVFTLEDFVGDWRQTAAYNTDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 659 - DNA, 477 bp, Artificial Sequence
  Synthetic
atggtcttcacactcgaagatttcgttggggactggcgacagacagccgcctacaacgtggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 660 - protein, 159 aa, Artificial Sequence
  Synthetic
MVFTLEDFVGDWRQTAAYNVDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 661 - DNA, 477 bp, Artificial Sequence
  Synthetic
atggtcttcacactcgaagatttcgttggggactggcgacagacagccgcctacaactgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 662 - protein, 159 aa, Artificial Sequence
  Synthetic
MVFTLEDFVGDWRQTAAYNWDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 663 - DNA, 477 bp, Artificial Sequence
  Synthetic
atggtcttcacactcgaagatttcgttggggactggcgacagacagccgcctacaactacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 664 - protein, 159 aa, Artificial Sequence
  Synthetic
MVFTLEDFVGDWRQTAAYNYDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 665 - DNA, 477 bp, Artificial Sequence
  Synthetic
atggtcttcacactcgaagatttcgttggggactggcgacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 666 - protein, 159 aa, Artificial Sequence
  Synthetic
MVFTLEDFVGDWRQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 667 - DNA, 477 bp, Artificial Sequence
  Synthetic
atggtcttcacactcgaagatttcgttggggactggcgacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 668 - protein, 159 aa, Artificial Sequence
  Synthetic
MVFTLEDFVGDWRQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 669 - DNA, 477 bp, Artificial Sequence
  Synthetic
atggtcttcacactcgaagatttcgttggggactggcgacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 670 - protein, 159 aa, Artificial Sequence
  Synthetic
MVFTLEDFVGDWRQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 671 - DNA, 477 bp, Artificial Sequence
  Synthetic
atggtcttcacactcgaagatttcgttggggactggcgacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 672 - protein, 159 aa, Artificial Sequence
  Synthetic
MVFTLEDFVGDWRQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 673 - DNA, 477 bp, Artificial Sequence
  Synthetic
atggtcttcacactcgaagatttcgttggggactggcgacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 674 - protein, 159 aa, Artificial Sequence
  Synthetic
MVFTLEDFVGDWRQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 675 - DNA, 477 bp, Artificial Sequence
  Synthetic
atggtcttcacactcgaagatttcgttggggactggcgacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 676 - protein, 159 aa, Artificial Sequence
  Synthetic
MVFTLEDFVGDWRQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 677 - DNA, 477 bp, Artificial Sequence
  Synthetic
atggtcttcacactcgaagatttcgttggggactggcgacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 678 - protein, 159 aa, Artificial Sequence
  Synthetic
MVFTLEDFVGDWRQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 679 - DNA, 477 bp, Artificial Sequence
  Synthetic
atggtcttcacactcgaagatttcgttggggactggcgacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 680 - protein, 159 aa, Artificial Sequence
  Synthetic
MVFTLEDFVGDWRQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 681 - DNA, 477 bp, Artificial Sequence
  Synthetic
atggtcttcacactcgaagatttcgttggggactggcgacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 682 - protein, 159 aa, Artificial Sequence
  Synthetic
MVFTLEDFVGDWRQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 683 - DNA, 477 bp, Artificial Sequence
  Synthetic
atggtcttcacactcgaagatttcgttggggactggcgacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 684 - protein, 159 aa, Artificial Sequence
  Synthetic
MVFTLEDFVGDWRQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 685 - DNA, 477 bp, Artificial Sequence
  Synthetic
atggtcttcacactcgaagatttcgttggggactggcgacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 686 - protein, 159 aa, Artificial Sequence
  Synthetic
MVFTLEDFVGDWRQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 687 - DNA, 477 bp, Artificial Sequence
  Synthetic
atggtcttcacactcgaagatttcgttggggactggcgacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 688 - protein, 159 aa, Artificial Sequence
  Synthetic
MVFTLEDFVGDWRQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 689 - DNA, 477 bp, Artificial Sequence
  Synthetic
atggtcttcacactcgaagatttcgttggggactggcgacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 690 - protein, 159 aa, Artificial Sequence
  Synthetic
MVFTLEDFVGDWRQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 691 - DNA, 477 bp, Artificial Sequence
  Synthetic
atggtcttcacactcgaagatttcgttggggactggcgacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 692 - protein, 159 aa, Artificial Sequence
  Synthetic
MVFTLEDFVGDWRQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 693 - DNA, 477 bp, Artificial Sequence
  Synthetic
atggtcttcacactcgaagatttcgttggggactggcgacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 694 - protein, 159 aa, Artificial Sequence
  Synthetic
MVFTLEDFVGDWRQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 695 - DNA, 477 bp, Artificial Sequence
  Synthetic
atggtcttcacactcgaagatttcgttggggactggcgacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 696 - protein, 159 aa, Artificial Sequence
  Synthetic
MVFTLEDFVGDWRQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 697 - DNA, 477 bp, Artificial Sequence
  Synthetic
atggtcttcacactcgaagatttcgttggggactggcgacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 698 - protein, 159 aa, Artificial Sequence
  Synthetic
MVFTLEDFVGDWRQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 699 - DNA, 477 bp, Artificial Sequence
  Synthetic
atggtcttcacactcgaagatttcgttggggactggcgacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 700 - protein, 159 aa, Artificial Sequence
  Synthetic
MVFTLEDFVGDWRQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 701 - DNA, 477 bp, Artificial Sequence
  Synthetic
atggtcttcacactcgaagatttcgttggggactggcgacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 702 - protein, 159 aa, Artificial Sequence
  Synthetic
MVFTLEDFVGDWRQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 703 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 704 - protein, 159 aa, Artificial Sequence
  Synthetic
MVFTLEDFVGDWRQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 705 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattgcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 706 - protein, 159 aa, Artificial Sequence
  Synthetic
MVFTLEDFVGDWRQTAAYNLDQVLEQGGVSSLFQNLAVSVTPIQRIVLSGENALKIDIHCIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 707 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 708 - protein, 159 aa, Artificial Sequence
  Synthetic
MVFTLEDFVGDWRQTAAYNLDQVLEQGGVSSLFQNLAVSVTPIQRIVLSGENALKIDIHDIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 709 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 710 - protein, 159 aa, Artificial Sequence
  Synthetic
MVFTLEDFVGDWRQTAAYNLDQVLEQGGVSSLFQNLAVSVTPIQRIVLSGENALKIDIHEIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 711 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatttcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 712 - protein, 159 aa, Artificial Sequence
  Synthetic
MVFTLEDFVGDWRQTAAYNLDQVLEQGGVSSLFQNLAVSVTPIQRIVLSGENALKIDIHFIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 713 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatggcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 714 - protein, 159 aa, Artificial Sequence
  Synthetic
MVFTLEDFVGDWRQTAAYNLDQVLEQGGVSSLFQNLAVSVTPIQRIVLSGENALKIDIHGIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 715 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 716 - protein, 159 aa, Artificial Sequence
  Synthetic
MVFTLEDFVGDWRQTAAYNLDQVLEQGGVSSLFQNLAVSVTPIQRIVLSGENALKIDIHHIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 717 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 718 - protein, 159 aa, Artificial Sequence
  Synthetic
MVFTLEDFVGDWRQTAAYNLDQVLEQGGVSSLFQNLAVSVTPIQRIVLSGENALKIDIHIIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 719 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 720 - protein, 159 aa, Artificial Sequence
  Synthetic
MVFTLEDFVGDWRQTAAYNLDQVLEQGGVSSLFQNLAVSVTPIQRIVLSGENALKIDIHKIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 721 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatctgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 722 - protein, 159 aa, Artificial Sequence
  Synthetic
MVFTLEDFVGDWRQTAAYNLDQVLEQGGVSSLFQNLAVSVTPIQRIVLSGENALKIDIHLIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 723 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 724 - protein, 159 aa, Artificial Sequence
  Synthetic
MVFTLEDFVGDWRQTAAYNLDQVLEQGGVSSLFQNLAVSVTPIQRIVLSGENALKIDIHMIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 725 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 726 - protein, 159 aa, Artificial Sequence
  Synthetic
MVFTLEDFVGDWRQTAAYNLDQVLEQGGVSSLFQNLAVSVTPIQRIVLSGENALKIDIHNIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 727 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 728 - protein, 159 aa, Artificial Sequence
  Synthetic
MVFTLEDFVGDWRQTAAYNLDQVLEQGGVSSLFQNLAVSVTPIQRIVLSGENALKIDIHPIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 729 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 730 - protein, 159 aa, Artificial Sequence
  Synthetic
MVFTLEDFVGDWRQTAAYNLDQVLEQGGVSSLFQNLAVSVTPIQRIVLSGENALKIDIHQIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 731 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 732 - protein, 159 aa, Artificial Sequence
  Synthetic
MVFTLEDFVGDWRQTAAYNLDQVLEQGGVSSLFQNLAVSVTPIQRIVLSGENALKIDIHRIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 733 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatagcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 734 - protein, 159 aa, Artificial Sequence
  Synthetic
MVFTLEDFVGDWRQTAAYNLDQVLEQGGVSSLFQNLAVSVTPIQRIVLSGENALKIDIHSIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 735 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 736 - protein, 159 aa, Artificial Sequence
  Synthetic
MVFTLEDFVGDWRQTAAYNLDQVLEQGGVSSLFQNLAVSVTPIQRIVLSGENALKIDIHTIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 737 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 738 - protein, 159 aa, Artificial Sequence
  Synthetic
MVFTLEDFVGDWRQTAAYNLDQVLEQGGVSSLFQNLAVSVTPIQRIVLSGENALKIDIHWIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 739 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 740 - protein, 159 aa, Artificial Sequence
  Synthetic
MVFTLEDFVGDWRQTAAYNLDQVLEQGGVSSLFQNLAVSVTPIQRIVLSGENALKIDIHYIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 741 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 742 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSCDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 743 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 744 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSDDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 745 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 746 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSEDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 747 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcttcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 748 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSFDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 749 - DNA, 477 bp, Artificial Sequence; identical to SEQ ID NO: 547
  Synthetic

SEQ ID NO: 750 - protein, 159 aa, Artificial Sequence; identical to SEQ ID NO: 548
  Synthetic

SEQ ID NO: 751 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 752 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSHDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 753 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 754 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSIDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 755 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 756 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSKDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 757 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcctggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 758 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSLDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 759 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 760 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSMDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 761 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 762 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSNDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 763 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 764 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSPDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 765 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 766 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSQDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 767 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 768 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSRDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 769 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcagcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 770 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSSDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 771 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 772 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSTDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 773 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgtggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 774 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSVDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 775 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 776 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSWDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 777 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 778 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSYDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 779 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 780 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNAIDYFGRPYEGIAVFDGKKITVTGTLWNGNKIIDERLINPDGSLLFRVTINV

SEQ ID NO: 781 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactgcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 782 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNCIDYFGRPYEGIAVFDGKKITVTGTLWNGNKIIDERLINPDGSLLFRVTINV

SEQ ID NO: 783 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 784 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNDIDYFGRPYEGIAVFDGKKITVTGTLWNGNKIIDERLINPDGSLLFRVTINV

SEQ ID NO: 785 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 786 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNEIDYFGRPYEGIAVFDGKKITVTGTLWNGNKIIDERLINPDGSLLFRVTINV

SEQ ID NO: 787 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacttcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 788 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNFIDYFGRPYEGIAVFDGKKITVTGTLWNGNKIIDERLINPDGSLLFRVTINV

SEQ ID NO: 789 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacggcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 790 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNGIDYFGRPYEGIAVFDGKKITVTGTLWNGNKIIDERLINPDGSLLFRVTINV

SEQ ID NO: 791 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 792 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNHIDYFGRPYEGIAVFDGKKITVTGTLWNGNKIIDERLINPDGSLLFRVTINV

SEQ ID NO: 793 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 794 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 795 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 796 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNKIDYFGRPYEGIAVFDGKKITVTGTLWNGNKIIDERLINPDGSLLFRVTINV

SEQ ID NO: 797 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacctgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 798 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNLIDYFGRPYEGIAVFDGKKITVTGTLWNGNKIIDERLINPDGSLLFRVTINV

SEQ ID NO: 799 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 800 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNNIDYFGRPYEGIAVFDGKKITVTGTLWNGNKIIDERLINPDGSLLFRVTINV

SEQ ID NO: 801 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 802 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNPIDYFGRPYEGIAVFDGKKITVTGTLWNGNKIIDERLINPDGSLLFRVTINV

SEQ ID NO: 803 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 804 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNQIDYFGRPYEGIAVFDGKKITVTGTLWNGNKIIDERLINPDGSLLFRVTINV

SEQ ID NO: 805 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 806 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNRIDYFGRPYEGIAVFDGKKITVTGTLWNGNKIIDERLINPDGSLLFRVTINV

SEQ ID NO: 807 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacagcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 808 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNSIDYFGRPYEGIAVFDGKKITVTGTLWNGNKIIDERLINPDGSLLFRVTINV

SEQ ID NO: 809 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 810 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNTIDYFGRPYEGIAVFDGKKITVTGTLWNGNKIIDERLINPDGSLLFRVTINV

SEQ ID NO: 811 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 812 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 813 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 814 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNWIDYFGRPYEGIAVFDGKKITVTGTLWNGNKIIDERLINPDGSLLFRVTINV

SEQ ID NO: 815 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 816 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNYIDYFGRPYEGIAVFDGKKITVTGTLWNGNKIIDERLINPDGSLLFRVTINV

SEQ ID NO: 817 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgccctgttccgagtaaccatcaacgtt

SEQ ID NO: 818 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSALFRVTINV

SEQ ID NO: 819 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctgcctgttccgagtaaccatcaacgtt

SEQ ID NO: 820 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSCLFRVTINV

SEQ ID NO: 821 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgacctgttccgagtaaccatcaacgtt

SEQ ID NO: 822 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSDLFRVTINV

SEQ ID NO: 823 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgagctgttccgagtaaccatcaacgtt

SEQ ID NO: 824 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSELFRVTINV

SEQ ID NO: 825 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccttcctgttccgagtaaccatcaacgtt

SEQ ID NO: 826 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSFLFRVTINV

SEQ ID NO: 827 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccggcctgttccgagtaaccatcaacgtt

SEQ ID NO: 828 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSGLFRVTINV

SEQ ID NO: 829 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccacctgttccgagtaaccatcaacgtt

SEQ ID NO: 830 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSHLFRVTINV

SEQ ID NO: 831 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatcctgttccgagtaaccatcaacgtt

SEQ ID NO: 832 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSILFRVTINV

SEQ ID NO: 833 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaagctgttccgagtaaccatcaacgtt

SEQ ID NO: 834 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSKLFRVTINV

SEQ ID NO: 835 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 836 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 837 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaacctgttccgagtaaccatcaacgtt

SEQ ID NO: 838 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSNLFRVTINV

SEQ ID NO: 839 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccccctgttccgagtaaccatcaacgtt

SEQ ID NO: 840 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSPLFRVTINV

SEQ ID NO: 841 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccagctgttccgagtaaccatcaacgtt

SEQ ID NO: 842 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSQLFRVTINV

SEQ ID NO: 843 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccggctgttccgagtaaccatcaacgtt

SEQ ID NO: 844 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSRLFRVTINV

SEQ ID NO: 845 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccagcctgttccgagtaaccatcaacgtt

SEQ ID NO: 846 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSSLFRVTINV

SEQ ID NO: 847 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaccctgttccgagtaaccatcaacgtt

SEQ ID NO: 848 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSTLFRVTINV

SEQ ID NO: 849 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgtgctgttccgagtaaccatcaacgtt

SEQ ID NO: 850 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSVLFRVTINV

SEQ ID NO: 851 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctggctgttccgagtaaccatcaacgtt

SEQ ID NO: 852 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSWLFRVTINV

SEQ ID NO: 853 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctacctgttccgagtaaccatcaacgtt

SEQ ID NO: 854 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSYLFRVTINV

SEQ ID NO: 855 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgcc

SEQ ID NO: 856 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINA

SEQ ID NO: 857 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgc

SEQ ID NO: 858 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINC

SEQ ID NO: 859 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 860 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 861 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgag

SEQ ID NO: 862 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINE

SEQ ID NO: 863 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacttc

SEQ ID NO: 864 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINF

SEQ ID NO: 865 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggc

SEQ ID NO: 866 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 867 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccac

SEQ ID NO: 868 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINH

SEQ ID NO: 869 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatc

SEQ ID NO: 870 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINI

SEQ ID NO: 871 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaag

SEQ ID NO: 872 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINK

SEQ ID NO: 873 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacctg

SEQ ID NO: 874 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINL

SEQ ID NO: 875 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatg

SEQ ID NO: 876 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINM

SEQ ID NO: 877 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaac

SEQ ID NO: 878 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINN

SEQ ID NO: 879 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 880 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 881 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccag

SEQ ID NO: 882 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINQ

SEQ ID NO: 883 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccgg

SEQ ID NO: 884 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINR

SEQ ID NO: 885 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 886 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 887 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacacc

SEQ ID NO: 888 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINT

SEQ ID NO: 889 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgg

SEQ ID NO: 890 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINW

SEQ ID NO: 891 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactac

SEQ ID NO: 892 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINY

SEQ ID NO: 893 - DNA, 477 bp, Artificial Sequence
  Synthetic
atggtcttcacactcgaagatttcgttggggactggcgacagacagccgcctacaacctggacaaggtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 894 - protein, 159 aa, Artificial Sequence
  Synthetic
MVFTLEDFVGDWRQTAAYNLDKVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 895 - DNA, 477 bp, Artificial Sequence
  Synthetic
atggtcttcacactcgaagatttcgttggggactggcgacagacagccgcctacaacctggaccaagtccttgaacagggaggtatgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 896 - protein, 159 aa, Artificial Sequence
  Synthetic
MVFTLEDFVGDWRQTAAYNLDQVLEQGGMSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 897 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaagctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 898 - protein, 159 aa, Artificial Sequence
  Synthetic
MVFTLEDFVGDWRQTAAYNLDQVLEQGGVSSLFQKLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 899 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccatcactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 900 - protein, 159 aa, Artificial Sequence
  Synthetic
MVFTLEDFVGDWRQTAAYNLDQVLEQGGVSSLFQNLAVSITPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 901 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 902 - protein, 159 aa, Artificial Sequence
  Synthetic
MVFTLEDFVGDWRQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 903 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 904 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 905 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 906 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 907 - DNA, 477 bp, Artificial Sequence
  Synthetic
atggtcttcacactcgaagatttcgttggggactggcgacagacagccgcctacaacctggaccaagtccttgaacagggaggtatgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 908 - protein, 159 aa, Artificial Sequence
  Synthetic
MVFTLEDFVGDWRQTAAYNLDQVLEQGGMSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 909 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 910 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 911 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 912 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 913 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 914 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 915 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 916 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSLLFRVTINV

SEQ ID NO: 917 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 918 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 919 - DNA, 477 bp, Artificial Sequence
  Synthetic
atggtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 920 - protein, 159 aa, Artificial Sequence
  Synthetic
MVFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 921 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 922 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 923 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 924 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINP

SEQ ID NO: 925 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 926 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINP

SEQ ID NO: 927 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 928 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINE

SEQ ID NO: 929 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 930 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINE

SEQ ID NO: 931 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 932 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINE

SEQ ID NO: 933 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 934 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 935 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 936 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 937 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 938 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 939 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 940 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 941 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 942 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 943 - DNA, 477 bp, Artificial Sequence
  Synthetic
atggtcttcacactcgaagatttcgttggggactggcgacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 944 - protein, 159 aa, Artificial Sequence
  Synthetic
MVFTLEDFVGDWRQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 945 - DNA, 477 bp, Artificial Sequence
  Synthetic
atggtcttcacactcgaagatttcgttggggactggcaacagacagccgcctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 946 - protein, 159 aa, Artificial Sequence
  Synthetic
MVFTLEDFVGDWNQTAAYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 947 - DNA, 477 bp, Artificial Sequence
  Synthetic
atggtcttcacactcgaagatttcgttggggactggcaacagacagccagctacaacctggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 948 - protein, 159 aa, Artificial Sequence
  Synthetic
MVFTLEDFVGDWNQTASYNLDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 949 - DNA, 477 bp, Artificial Sequence
  Synthetic
atggtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 950 - protein, 159 aa, Artificial Sequence
  Synthetic
MVFTLEDFVGDWNQTASYNQDQVLEQGGVSSLFQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 951 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 952 - protein, 159 aa, Artificial Sequence
  Synthetic
MVFTLEDFVGDWNQTASYNQDQVLEQGGVSSLIQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 953 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 954 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 955 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 956 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 957 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 958 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSLLFRVTIND

SEQ ID NO: 959 - DNA, 477 bp, Artificial Sequence
  Synthetic
atggtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 960 - protein, 159 aa, Artificial Sequence
  Synthetic
MVFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTINV

SEQ ID NO: 961 - DNA, 477 bp, Artificial Sequence
  Synthetic
atggtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 962 - protein, 159 aa, Artificial Sequence
  Synthetic
MVFTLEDFVGDWRQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 963 - DNA, 477 bp, Artificial Sequence
  Synthetic
atggtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 964 - protein, 159 aa, Artificial Sequence
  Synthetic
MVFTLEDFVGDWRQTASYNQDQVLEQGGVSSLFQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 965 - DNA, 477 bp, Artificial Sequence
  Synthetic
atggtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 966 - protein, 159 aa, Artificial Sequence
  Synthetic
MVFTLEDFVGDWNQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 967 - DNA, 480 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtg

SEQ ID NO: 968 - protein, 160 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPV

SEQ ID NO: 969 - DNA, 480 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgcc

SEQ ID NO: 970 - protein, 160 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPA

SEQ ID NO: 971 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgacc

SEQ ID NO: 972 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVT

SEQ ID NO: 973 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtggcc

SEQ ID NO: 974 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVA

SEQ ID NO: 975 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccacc

SEQ ID NO: 976 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAT

SEQ ID NO: 977 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccgcc

SEQ ID NO: 978 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAA

SEQ ID NO: 979 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcggc

SEQ ID NO: 980 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGG

SEQ ID NO: 981 - DNA, 483 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcacc

SEQ ID NO: 982 - protein, 161 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGT

SEQ ID NO: 983 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccaccggc

SEQ ID NO: 984 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPATG

SEQ ID NO: 985 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggc

SEQ ID NO: 986 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTG

SEQ ID NO: 987 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccgcc

SEQ ID NO: 988 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTA

SEQ ID NO: 989 - DNA, 486 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcaccgcc

SEQ ID NO: 990 - protein, 162 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGTA

SEQ ID NO: 991 - DNA, 489 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgg

SEQ ID NO: 992 - protein, 163 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGW

SEQ ID NO: 993 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcgg

SEQ ID NO: 994 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWR

SEQ ID NO: 995 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgggag

SEQ ID NO: 996 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWE

SEQ ID NO: 997 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggaag

SEQ ID NO: 998 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWK

SEQ ID NO: 999 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcag

SEQ ID NO: 1000 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWQ

SEQ ID NO: 1001 - DNA, 492 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcac

SEQ ID NO: 1002 - protein, 164 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWH

SEQ ID NO: 1003 - DNA, 474 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaac

SEQ ID NO: 1004 - protein, 158 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIN

SEQ ID NO: 1005 - DNA, 471 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatc

SEQ ID NO: 1006 - protein, 157 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTI

SEQ ID NO: 1007 - DNA, 468 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaacc

SEQ ID NO: 1008 - protein, 156 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVT

SEQ ID NO: 1009 - DNA, 465 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagta

SEQ ID NO: 1010 - protein, 155 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRV

SEQ ID NO: 1011 - DNA, 462 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccga

SEQ ID NO: 1012 - protein, 154 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFR

SEQ ID NO: 1013 - DNA, 459 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttc

SEQ ID NO: 1014 - protein, 153 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLF

SEQ ID NO: 1015 - DNA, 456 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctg

SEQ ID NO: 1016 - protein, 152 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSML

SEQ ID NO: 1017 - DNA, 477 bp, Artificial Sequence
  Synthetic
atggtcttcacactcgaagatttcgttggggactgggaacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1018 - protein, 159 aa, Artificial Sequence
  Synthetic
MVFTLEDFVGDWEQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1019 - DNA, 477 bp, Artificial Sequence
  Synthetic
atggtcttcacactcgaagatttcgttggggactgggaacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1020 - protein, 159 aa, Artificial Sequence
  Synthetic
MVFTLEDFVGDWEQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1021 - DNA, 477 bp, Artificial Sequence
  Synthetic
atggtcttcacactcgaagatttcgttggggactgggaacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1022 - protein, 159 aa, Artificial Sequence
  Synthetic
MVFTLEDFVGDWEQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1023 - DNA, 477 bp, Artificial Sequence
  Synthetic
atggtcttcacactcgaagatttcgttggggactgggaacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1024 - protein, 159 aa, Artificial Sequence
  Synthetic
MVFTLEDFVGDWEQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1025 - DNA, 477 bp, Artificial Sequence
  Synthetic
atggtcttcacactcgaagatttcgttggggactgggaacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1026 - protein, 159 aa, Artificial Sequence
  Synthetic
MVFTLEDFVGDWEQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1027 - DNA, 477 bp, Artificial Sequence
  Synthetic
atggtcttcacactcgaagatttcgttggggactgggaacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1028 - protein, 159 aa, Artificial Sequence
  Synthetic
MVFTLEDFVGDWEQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1029 - DNA, 477 bp, Artificial Sequence
  Synthetic
atggtcttcacactcgaagatttcgttggggactgggaacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1030 - protein, 159 aa, Artificial Sequence
  Synthetic
MVFTLEDFVGDWEQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1031 - DNA, 477 bp, Artificial Sequence
  Synthetic
atggtcttcacactcgaagatttcgttggggactgggaacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1032 - protein, 159 aa, Artificial Sequence
  Synthetic
MVFTLEDFVGDWEQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1033 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1034 - protein, 159 aa, Artificial Sequence
  Synthetic
MVFTLEDFVGDWEQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1035 - DNA, 477 bp, Artificial Sequence
  Synthetic
atggtcttcacactcgaagatttcgttggggactgggaacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1036 - protein, 159 aa, Artificial Sequence
  Synthetic
MVFTLEDFVGDWEQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1037 - DNA, 477 bp, Artificial Sequence
  Synthetic
atggtcttcacactcgaagatttcgttggggactgggaacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1038 - protein, 159 aa, Artificial Sequence
  Synthetic
MVFTLEDFVGDWEQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1039 - DNA, 477 bp, Artificial Sequence
  Synthetic
atggtcttcacactcgaagatttcgttggggactgggaacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1040 - protein, 159 aa, Artificial Sequence
  Synthetic
MVFTLEDFVGDWEQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1041 - DNA, 477 bp, Artificial Sequence
  Synthetic
atggtcttcacactcgaagatttcgttggggactgggaacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1042 - protein, 159 aa, Artificial Sequence
  Synthetic
MVFTLEDFVGDWEQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1043 - DNA, 477 bp, Artificial Sequence
  Synthetic
atggtcttcacactcgaagatttcgttggggactgggaacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1044 - protein, 159 aa, Artificial Sequence
  Synthetic
MVFTLEDFVGDWEQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1045 - DNA, 477 bp, Artificial Sequence
  Synthetic
atggtcttcacactcgaagatttcgttggggactgggaacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1046 - protein, 159 aa, Artificial Sequence
  Synthetic
MVFTLEDFVGDWEQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1047 - DNA, 477 bp, Artificial Sequence
  Synthetic
atggtcttcacactcgaagatttcgttggggactgggaacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1048 - protein, 159 aa, Artificial Sequence
  Synthetic
MVFTLEDFVGDWEQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1049 - DNA, 477 bp, Artificial Sequence
  Synthetic
atggtcttcacactcgaagatttcgttggggactgggaacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1050 - protein, 159 aa, Artificial Sequence
  Synthetic
MVFTLEDFVGDWEQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1051 - DNA, 477 bp, Artificial Sequence
  Synthetic
atggtcttcacactcgaagatttcgttggggactgggaacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1052 - protein, 159 aa, Artificial Sequence
  Synthetic
MVFTLEDFVGDWEQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1053 - DNA, 477 bp, Artificial Sequence
  Synthetic
atggtcttcacactcgaagatttcgttggggactgggaacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1054 - protein, 159 aa, Artificial Sequence
  Synthetic
MVFTLEDFVGDWEQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1055 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1056 - protein, 159 aa, Artificial Sequence
  Synthetic
MVFTLEDFVGDWEQTAAYNLDQVLEQGGVSSLFQNLAVSVTPIQRIVASGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1057 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctgcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1058 - protein, 159 aa, Artificial Sequence
  Synthetic
MVFTLEDFVGDWEQTAAYNLDQVLEQGGVSSLFQNLAVSVTPIQRIVCSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1059 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1060 - protein, 159 aa, Artificial Sequence
  Synthetic
MVFTLEDFVGDWEQTAAYNLDQVLEQGGVSSLFQNLAVSVTPIQRIVDSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1061 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1062 - protein, 159 aa, Artificial Sequence
  Synthetic
MVFTLEDFVGDWEQTAAYNLDQVLEQGGVSSLFQNLAVSVTPIQRIVESGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1063 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcttcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1064 - protein, 159 aa, Artificial Sequence
  Synthetic
MVFTLEDFVGDWEQTAAYNLDQVLEQGGVSSLFQNLAVSVTPIQRIVFSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1065 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcggcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1066 - protein, 159 aa, Artificial Sequence
  Synthetic
MVFTLEDFVGDWEQTAAYNLDQVLEQGGVSSLFQNLAVSVTPIQRIVGSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1067 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1068 - protein, 159 aa, Artificial Sequence
  Synthetic
MVFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1069 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1070 - protein, 159 aa, Artificial Sequence
  Synthetic
MVFTLEDFVGDWEQTAAYNLDQVLEQGGVSSLFQNLAVSVTPIQRIVISGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1071 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1072 - protein, 159 aa, Artificial Sequence
  Synthetic
MVFTLEDFVGDWEQTAAYNLDQVLEQGGVSSLFQNLAVSVTPIQRIVKSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1073 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1074 - protein, 159 aa, Artificial Sequence
  Synthetic
MVFTLEDFVGDWEQTAAYNLDQVLEQGGVSSLFQNLAVSVTPIQRIVMSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1075 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1076 - protein, 159 aa, Artificial Sequence
  Synthetic
MVFTLEDFVGDWEQTAAYNLDQVLEQGGVSSLFQNLAVSVTPIQRIVNSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1077 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1078 - protein, 159 aa, Artificial Sequence
  Synthetic
MVFTLEDFVGDWEQTAAYNLDQVLEQGGVSSLFQNLAVSVTPIQRIVPSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1079 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1080 - protein, 159 aa, Artificial Sequence
  Synthetic
MVFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1081 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1082 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1083 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcagcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1084 - protein, 159 aa, Artificial Sequence
  Synthetic
MVFTLEDFVGDWEQTAAYNLDQVLEQGGVSSLFQNLAVSVTPIQRIVSSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1085 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1086 - protein, 159 aa, Artificial Sequence
  Synthetic
MVFTLEDFVGDWEQTAAYNLDQVLEQGGVSSLFQNLAVSVTPIQRIVTSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1087 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgtgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1088 - protein, 159 aa, Artificial Sequence
  Synthetic
MVFTLEDFVGDWEQTAAYNLDQVLEQGGVSSLFQNLAVSVTPIQRIVVSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1089 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1090 - protein, 159 aa, Artificial Sequence
  Synthetic
MVFTLEDFVGDWEQTAAYNLDQVLEQGGVSSLFQNLAVSVTPIQRIVWSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1091 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtctacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1092 - protein, 159 aa, Artificial Sequence
  Synthetic
MVFTLEDFVGDWEQTAAYNLDQVLEQGGVSSLFQNLAVSVTPIQRIVYSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1093 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgcctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1094 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIAYFGRPYEGIAVFDGKKITVTGTLWNGNKIIDERLITPDGSMLFRVTINP

SEQ ID NO: 1095 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctgctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1096 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMICYFGRPYEGIAVFDGKKITVTGTLWNGNKIIDERLITPDGSMLFRVTINP

SEQ ID NO: 1097 - DNA, 477 bp, Artificial Sequence; identical to SEQ ID NO: 925
  Synthetic

SEQ ID NO: 1098 - protein, 159 aa, Artificial Sequence; identical to SEQ ID NO: 926
  Synthetic

SEQ ID NO: 1099 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1100 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIEYFGRPYEGIAVFDGKKITVTGTLWNGNKIIDERLITPDGSMLFRVTINP

SEQ ID NO: 1101 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcttctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1102 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIFYFGRPYEGIAVFDGKKITVTGTLWNGNKIIDERLITPDGSMLFRVTINP

SEQ ID NO: 1103 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcggctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1104 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIGYFGRPYEGIAVFDGKKITVTGTLWNGNKIIDERLITPDGSMLFRVTINP

SEQ ID NO: 1105 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1106 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIHYFGRPYEGIAVFDGKKITVTGTLWNGNKIIDERLITPDGSMLFRVTINP

SEQ ID NO: 1107 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1108 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIIYFGRPYEGIAVFDGKKITVTGTLWNGNKIIDERLITPDGSMLFRVTINP

SEQ ID NO: 1109 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1110 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIKYFGRPYEGIAVFDGKKITVTGTLWNGNKIIDERLITPDGSMLFRVTINP

SEQ ID NO: 1111 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcctgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1112 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMILYFGRPYEGIAVFDGKKITVTGTLWNGNKIIDERLITPDGSMLFRVTINP

SEQ ID NO: 1113 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1114 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIMYFGRPYEGIAVFDGKKITVTGTLWNGNKIIDERLITPDGSMLFRVTINP

SEQ ID NO: 1115 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcccctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1116 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIPYFGRPYEGIAVFDGKKITVTGTLWNGNKIIDERLITPDGSMLFRVTINP

SEQ ID NO: 1117 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1118 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIQYFGRPYEGIAVFDGKKITVTGTLWNGNKIIDERLITPDGSMLFRVTINP

SEQ ID NO: 1119 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1120 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIRYFGRPYEGIAVFDGKKITVTGTLWNGNKIIDERLITPDGSMLFRVTINP

SEQ ID NO: 1121 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcagctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1122 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMISYFGRPYEGIAVFDGKKITVTGTLWNGNKIIDERLITPDGSMLFRVTINP

SEQ ID NO: 1123 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcacctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1124 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMITYFGRPYEGIAVFDGKKITVTGTLWNGNKIIDERLITPDGSMLFRVTINP

SEQ ID NO: 1125 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgtgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1126 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIVYFGRPYEGIAVFDGKKITVTGTLWNGNKIIDERLITPDGSMLFRVTINP

SEQ ID NO: 1127 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1128 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIWYFGRPYEGIAVFDGKKITVTGTLWNGNKIIDERLITPDGSMLFRVTINP

SEQ ID NO: 1129 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1130 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIYYFGRPYEGIAVFDGKKITVTGTLWNGNKIIDERLITPDGSMLFRVTINP

SEQ ID NO: 1131 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgcccccgacggctccatgctgttccgagtaaccatcaacccc

SEQ ID NO: 1132 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIAPDGSMLFRVTINP

SEQ ID NO: 1133 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctgccccgacggctccatgctgttccgagtaaccatcaacccc

SEQ ID NO: 1134 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLICPDGSMLFRVTINP

SEQ ID NO: 1135 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgaccccgacggctccatgctgttccgagtaaccatcaacccc

SEQ ID NO: 1136 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIDPDGSMLFRVTINP

SEQ ID NO: 1137 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgagcccgacggctccatgctgttccgagtaaccatcaacccc

SEQ ID NO: 1138 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIEPDGSMLFRVTINP

SEQ ID NO: 1139 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcttccccgacggctccatgctgttccgagtaaccatcaacccc

SEQ ID NO: 1140 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIFPDGSMLFRVTINP

SEQ ID NO: 1141 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcggccccgacggctccatgctgttccgagtaaccatcaacccc

SEQ ID NO: 1142 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIGPDGSMLFRVTINP

SEQ ID NO: 1143 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccaccccgacggctccatgctgttccgagtaaccatcaacccc

SEQ ID NO: 1144 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIHPDGSMLFRVTINP

SEQ ID NO: 1145 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatccccgacggctccatgctgttccgagtaaccatcaacccc

SEQ ID NO: 1146 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIIPDGSMLFRVTINP

SEQ ID NO: 1147 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaagcccgacggctccatgctgttccgagtaaccatcaacccc

SEQ ID NO: 1148 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIKPDGSMLFRVTINP

SEQ ID NO: 1149 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcctgcccgacggctccatgctgttccgagtaaccatcaacccc

SEQ ID NO: 1150 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLILPDGSMLFRVTINP

SEQ ID NO: 1151 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatgcccgacggctccatgctgttccgagtaaccatcaacccc

SEQ ID NO: 1152 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIMPDGSMLFRVTINP

SEQ ID NO: 1153 - DNA, 477 bp, Artificial Sequence; identical to SEQ ID NO: 923
  Synthetic

SEQ ID NO: 1154 - protein, 159 aa, Artificial Sequence; identical to SEQ ID NO: 924
  Synthetic

SEQ ID NO: 1155 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcccccccgacggctccatgctgttccgagtaaccatcaacccc

SEQ ID NO: 1156 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIPPDGSMLFRVTINP

SEQ ID NO: 1157 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccagcccgacggctccatgctgttccgagtaaccatcaacccc

SEQ ID NO: 1158 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIQPDGSMLFRVTINP

SEQ ID NO: 1159 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccggcccgacggctccatgctgttccgagtaaccatcaacccc

SEQ ID NO: 1160 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIRPDGSMLFRVTINP

SEQ ID NO: 1161 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcagccccgacggctccatgctgttccgagtaaccatcaacccc

SEQ ID NO: 1162 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLISPDGSMLFRVTINP

SEQ ID NO: 1163 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgtgcccgacggctccatgctgttccgagtaaccatcaacccc

SEQ ID NO: 1164 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIVPDGSMLFRVTINP

SEQ ID NO: 1165 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctggcccgacggctccatgctgttccgagtaaccatcaacccc

SEQ ID NO: 1166 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIWPDGSMLFRVTINP

SEQ ID NO: 1167 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctaccccgacggctccatgctgttccgagtaaccatcaacccc

SEQ ID NO: 1168 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIYPDGSMLFRVTINP

SEQ ID NO: 1169 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgcc

SEQ ID NO: 1170 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINA

SEQ ID NO: 1171 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgc

SEQ ID NO: 1172 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINC

SEQ ID NO: 1173 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgac

SEQ ID NO: 1174 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIND

SEQ ID NO: 1175 - DNA, 477 bp, Artificial Sequence; identical to SEQ ID NO: 937
  Synthetic

SEQ ID NO: 1176 - protein, 159 aa, Artificial Sequence; identical to SEQ ID NO: 938
  Synthetic

SEQ ID NO: 1177 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacttc

SEQ ID NO: 1178 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINF

SEQ ID NO: 1179 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggc

SEQ ID NO: 1180 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTING

SEQ ID NO: 1181 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1182 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1183 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatc

SEQ ID NO: 1184 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINI

SEQ ID NO: 1185 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaag

SEQ ID NO: 1186 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINK

SEQ ID NO: 1187 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacctg

SEQ ID NO: 1188 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINL

SEQ ID NO: 1189 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatg

SEQ ID NO: 1190 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINM

SEQ ID NO: 1191 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaac

SEQ ID NO: 1192 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINN

SEQ ID NO: 1193 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccag

SEQ ID NO: 1194 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINQ

SEQ ID NO: 1195 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccgg

SEQ ID NO: 1196 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINR

SEQ ID NO: 1197 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1198 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 1199 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacacc

SEQ ID NO: 1200 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINT

SEQ ID NO: 1201 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgtg

SEQ ID NO: 1202 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINV

SEQ ID NO: 1203 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgg

SEQ ID NO: 1204 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINW

SEQ ID NO: 1205 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactac

SEQ ID NO: 1206 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINY

SEQ ID NO: 1207 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1208 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMLNYFGRPYEGIAVFDGKKITVTGTLWNGNKIIDERLITPDGSMLFRVTINP

SEQ ID NO: 1209 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1210 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEEIFKVVYPVDDHHFKVILHYGTLVIDGVTPNMINYFGRPYEGIAVFDGKKITVTGTLWNGNKIIDERLITPDGSMLFRVTINP

SEQ ID NO: 1211 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcgacccc

SEQ ID NO: 1212 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTIDP

SEQ ID NO: 1213 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1214 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKVFKVVYPVDDHHFKVILHYGTLVIDGVTPNMINYFGRPYEGIAVFDGKKITVTGTLWNGNKIIDERLITPDGSMLFRVTINP

SEQ ID NO: 1215 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcatgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1216 - protein, 159 aa, Artificial Sequence
  Synthetic
MVFTLEDFVGDWEQTAAYNLDQVLEQGGVSSLFQNLAVSVTPIQRIVLSDENALKIDIRVIIPYEGLSADQMAQIEKIFKVVYPVDDHHFKVIMHYGTLVVDGVTPNMINYFGRPYEGIAVFDGKKITVTGTLWNGNKIIDERLITPDGSMLFRVTINP

SEQ ID NO: 1217 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1218 - protein, 159 aa, Artificial Sequence
  Synthetic
MVFTLEDFVGDWEQTAAYNLDQVLEQGGVSSLLQNLAASVTPIQRIVLSGENALKIDIHVIIPYEGLSADQMAQIEKIFKVVYPVDDHHFKVILHYGTLVVDGVTPNMINYFGRPYEGIAVFDGKKITVTGTLWNGNKIIDERLITPDGSMLFRVTINP

SEQ ID NO: 1219 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1220 - protein, 159 aa, Artificial Sequence
  Synthetic
MVFTLEDFVGDWEQTAAYNLDQVLEQGGVSSLLQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1221 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggccatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1222 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKAILHYGTLVIDGVTPNMINYFGRPYEGIAVFDGKKITVTGTLWNGNKIIDERLITPDGSMLFRVTINP

SEQ ID NO: 1223 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaagggtggtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1224 - protein, 159 aa, Artificial Sequence
  Synthetic
MVFTLEDFVGDWEQTAAYNLDQVLEQGGVSSLFQNLAVSVTPIQRVVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1225 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacgtgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1226 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDQHFKVILHYGTLVIDGVTPNVINYFGRPYEGIAVFDGKKITVTGTLWNGNKIIDERLITPDGSMLFRVTINP

SEQ ID NO: 1227 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcacctgatcacccccgacggctccatgctgttccgagtaaccatcaacccc

SEQ ID NO: 1228 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDEHLITPDGSMLFRVTINP

SEQ ID NO: 1229 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcaggacctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1230 - protein, 159 aa, Artificial Sequence
  Synthetic
MVFTLEDFVGDWEQTAAYNLDQVLEQGGVSSLFQDLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1231 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggccacaaaattatcgacgagcgcctgatcacccccgacggctccatgctgttccgagtaaccatcaacccc

SEQ ID NO: 1232 - protein, 159 aa, Artificial Sequence
  Synthetic
MVFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGHKIIDERLITPDGSMLFRVTINP

SEQ ID NO: 1233 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1234 - protein, 159 aa, Artificial Sequence
  Synthetic
MVFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1235 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcgtgccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1236 - protein, 159 aa, Artificial Sequence
  Synthetic
MVFTLEDFVGDWEQTAAYNLDQVLEQGGVSSLFQNLAVSVTPIQRIVLSGENALKIDIHVIVPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1237 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcaaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1238 - protein, 159 aa, Artificial Sequence
  Synthetic
MVFTLEDFVGDWEQTAAYNLDQVLEQGGVSSLFQNLAVSVTPIQRIVLSGENTLKIDIHVIIPYEGLSADQMAQIKKIFKVVYPVDDHHFKVILHYGTLVIDGVTPNMINYFGRLYEGIAVFDGKKITVTGTLWNGNKIIDERLITPDGSMLFRVTINP

SEQ ID NO: 1239 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1240 - protein, 159 aa, Artificial Sequence
  Synthetic
MVFTLEDFVGDWEQTAAYNLDQVLEQGGVSSLFQNLAASVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1241 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1242 - protein, 159 aa, Artificial Sequence
  Synthetic
MVFTLEDFVGDWEQTAAYNLDQVLEQGGVSSLFQNLAVSVTPIQRIVLSGENTLKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1243 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1244 - protein, 159 aa, Artificial Sequence
  Synthetic
MVFTLEDFVGDWEQTAAYNLDQVLEQGGVSSLFQNLAVSVTPIQRIVLSGENALKIDIRVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1245 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1246 - protein, 159 aa, Artificial Sequence
  Synthetic
MVFTLEDFVGDWEQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1247 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcaagaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1248 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIKKIFKVVYPVDDHHFKVILHYGTLVIDGVTPNMINYFGRPYEGIAVFDGKKITVTGTLWNGNKIIDERLITPDGSMLFRVTINP

SEQ ID NO: 1249 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1250 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDQHFKVILHYGTLVIDGVTPNMINYFGRPYEGIAVFDGKKITVTGTLWNGNKIIDERLITPDGSMLFRVTINP

SEQ ID NO: 1251 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1252 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1253 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacccc

SEQ ID NO: 1254 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTINP

SEQ ID NO: 1255 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaagcgggaccctgtggaacggcaacaaaattatcgacgagcgcctgatcacccccgacggctccatgctgttccgagtaaccatcaacccc

SEQ ID NO: 1256 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVSGTLWNGNKIIDERLITPDGSMLFRVTINP

SEQ ID NO: 1257 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgccagatcacccccgacggctccatgctgttccgagtaaacatcaacccc

SEQ ID NO: 1258 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERQITPDGSMLFRVNINP

SEQ ID NO: 1259 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcgacccc

SEQ ID NO: 1260 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIDP

SEQ ID NO: 1261 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccaggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1262 - protein, 159 aa, Artificial Sequence
  Synthetic
MVFTLEDFVGDWEQTAAYNLDQVLEQGGVSSLFQNLAVSVTPIQRIVLSGENALKIDIQVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1263 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcatgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1264 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVIMHYGTLVIDGVTPNMINYFGRPYEGIAVFDGKKITVTGTLWNGNKIIDERLITPDGSMLFRVTINP

SEQ ID NO: 1265 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1266 - protein, 159 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRLYEGIAVFDGKKITVTGTLWNGNKIIDERLITPDGSMLFRVTINP

SEQ ID NO: 1267 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1268 - protein, 159 aa, Artificial Sequence
  Synthetic
MVFTLEDFVGDWEQTAAYNLDQVLEQGGVSSLFQNLAVSVTPIQRIVLSDENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1269 - DNA, 444 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgac

SEQ ID NO: 1270 - protein, 148 aa, Artificial Sequence
  Synthetic
MVFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPD

SEQ ID NO: 1271 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1272 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 1273 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 1274 - protein, 159 aa, Artificial Sequence
  Synthetic
MVFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 1275 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1276 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1277 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1278 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 1279 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1280 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINP

SEQ ID NO: 1281 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1282 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINP

SEQ ID NO: 1283 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1284 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINS

SEQ ID NO: 1285 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1286 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINS

SEQ ID NO: 1287 - DNA, 477 bp, Artificial Sequence
  Synthetic
atggtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1288 - protein, 159 aa, Artificial Sequence
  Synthetic
MVFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINS

SEQ ID NO: 1289 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1290 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 1291 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1292 - protein, 159 aa, Artificial Sequence
  Synthetic
MVFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 1293 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1294 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEKVFKVVYPVDDHHFKVILPYGTLVIDGVTPNMLNYFGRPYEGIAVFDGKKITVTGTLWNGNKIIDERLITPDGSMLFRVTINS

SEQ ID NO: 1295 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1296 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEIFKVVYPVDDHHFKVILPYGTLVIDGVTPNMLNYFGRPYEGIAVFDGKKITVTGTLWNGNKIIDERLITPDGSMLFRVTINS

SEQ ID NO: 1297 - DNA, 477 bp, Artificial Sequence
  Synthetic
atggtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 1298 - protein, 159 aa, Artificial Sequence
  Synthetic
MVFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMINYFGRPYEGIAVFDGKKITVTGTLWNGNKIIDERLITPDGSMLFRVTINS

SEQ ID NO: 1299 - DNA, 474 bp, Artificial Sequence
  Synthetic
gtcttcacactcgaagatttcgttggggactggcaacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1300 - protein, 158 aa, Artificial Sequence
  Synthetic
VFTLEDFVGDWNQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1301 - DNA, 474 bp, Artificial Sequence
  Synthetic
gtcttcacactcgaagatttcgttggggactggcgacagatcgccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1302 - protein, 158 aa, Artificial Sequence
  Synthetic
VFTLEDFVGDWRQIAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1303 - DNA, 474 bp, Artificial Sequence
  Synthetic
gtcttcacactcgaagatttcgttggggactggcgacagacagccagctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1304 - protein, 158 aa, Artificial Sequence
  Synthetic
VFTLEDFVGDWRQTASYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1305 - DNA, 474 bp, Artificial Sequence
  Synthetic
gtcttcacactcgaagatttcgttggggactggcgacagacagccggctacaaccaggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1306 - protein, 158 aa, Artificial Sequence
  Synthetic
VFTLEDFVGDWRQTAGYNQDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1307 - DNA, 474 bp, Artificial Sequence
  Synthetic
gtcttcacactcgaagatttcgttggggactggcgacagacagccggctacaacctggacaaggtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1308 - protein, 158 aa, Artificial Sequence
  Synthetic
VFTLEDFVGDWRQTAGYNLDKVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1309 - DNA, 474 bp, Artificial Sequence
  Synthetic
gtcttcacactcgaagatttcgttggggactggcgacagacagccggctacaacctggaccaagtccttgaacagggaggtatgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1310 - protein, 158 aa, Artificial Sequence
  Synthetic
VFTLEDFVGDWRQTAGYNLDQVLEQGGMSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1311 - DNA, 474 bp, Artificial Sequence
  Synthetic
gtcttcacactcgaagatttcgttggggactggcgacagacagccggctacaacctggaccaagtccttgaacagggaggtgtgtccagtttgatacagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1312 - protein, 158 aa, Artificial Sequence
  Synthetic
VFTLEDFVGDWRQTAGYNLDQVLEQGGVSSLIQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1313 - DNA, 474 bp, Artificial Sequence
  Synthetic
gtcttcacactcgaagatttcgttggggactggcgacagacagccggctacaacctggaccaagtccttgaacagggaggtgtgtccagtttgttgcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1314 - protein, 158 aa, Artificial Sequence
  Synthetic
VFTLEDFVGDWRQTAGYNLDQVLEQGGVSSLLQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1315 - DNA, 474 bp, Artificial Sequence
  Synthetic
gtcttcacactcgaagatttcgttggggactggcgacagacagccggctacaacctggaccaagtccttgaacagggaggtgtgtccagtttggttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1316 - protein, 158 aa, Artificial Sequence
  Synthetic
VFTLEDFVGDWRQTAGYNLDQVLEQGGVSSLVQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1317 - DNA, 474 bp, Artificial Sequence
  Synthetic
gtcttcacactcgaagatttcgttggggactggcgacagacagccggctacaacctggaccaagtccttgaacagggaggtgtgtccagtttgtttcggaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1318 - protein, 158 aa, Artificial Sequence
  Synthetic
VFTLEDFVGDWRQTAGYNLDQVLEQGGVSSLFRNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1319 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaaactcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1320 - protein, 158 aa, Artificial Sequence
  Synthetic
VFTLEDFVGDWRQTAGYNLDQVLEQGGVSSLFQKLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1321 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagcggctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1322 - protein, 158 aa, Artificial Sequence
  Synthetic
VFTLEDFVGDWRQTAGYNLDQVLEQGGVSSLFQRLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1323 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacaaccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1324 - protein, 158 aa, Artificial Sequence
  Synthetic
VFTLEDFVGDWRQTAGYNLDQVLEQGGVSSLFQNLGVSVTPIQRIVLSGENGLKIDNHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1325 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgccatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1326 - protein, 158 aa, Artificial Sequence
  Synthetic
VFTLEDFVGDWRQTAGYNLDQVLEQGGVSSLFQNLGVSVTPIQRIVLSGENGLKIDIHAIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1327 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcaccatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1328 - protein, 158 aa, Artificial Sequence
  Synthetic
VFTLEDFVGDWRQTAGYNLDQVLEQGGVSSLFQNLGVSVTPIQRIVLSGENGLKIDIHVTIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1329 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcagcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1330 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSSDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1331 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgacgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1332 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSDDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1333 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1334 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 1335 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1336 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 1337 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacattatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1338 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 1339 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1340 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 1341 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacagccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1342 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGQPYEGIAVFDGKKITVTGTLWNGNKIIDERLINPDGSLLFRVTINV

SEQ ID NO: 1343 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1344 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 1345 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1346 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1347 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcgacgtt

SEQ ID NO: 1348 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIDV

SEQ ID NO: 1349 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcagcgtt

SEQ ID NO: 1350 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTISV

SEQ ID NO: 1351 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgat

SEQ ID NO: 1352 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 1353 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 1354 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 1355 - DNA, 474 bp, Artificial Sequence
  Synthetic
gtcttcacactcgaagatttcgttgccgactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1356 - protein, 158 aa, Artificial Sequence
  Synthetic
VFTLEDFVADWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1357 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1358 - protein, 158 aa, Artificial Sequence
  Synthetic
VFTLEDFVGDWRQTAAYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1359 - DNA, 474 bp, Artificial Sequence
  Synthetic
gtcttcacactcgaagatttcgttggggactggcgacagacagccggctacaacctggaccaagtccttgaacaggccggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1360 - protein, 158 aa, Artificial Sequence
  Synthetic
VFTLEDFVGDWRQTAGYNLDQVLEQAGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1361 - DNA, 474 bp, Artificial Sequence
  Synthetic
gtcttcacactcgaagatttcgttggggactggcgacagacagccggctacaacctggaccaagtccttgaacagggagccgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1362 - protein, 158 aa, Artificial Sequence
  Synthetic
VFTLEDFVGDWRQTAGYNLDQVLEQGAVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1363 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1364 - protein, 158 aa, Artificial Sequence
  Synthetic
VFTLEDFVGDWRQTAGYNLDQVLEQGGVSSLFQNLAVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1365 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcgccgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1366 - protein, 158 aa, Artificial Sequence
  Synthetic
VFTLEDFVGDWRQTAGYNLDQVLEQGGVSSLFQNLGVSVTPIQRIVLSAENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1367 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1368 - protein, 158 aa, Artificial Sequence
  Synthetic
VFTLEDFVGDWRQTAGYNLDQVLEQGGVSSLFQNLGVSVTPIQRIVLSGENALKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1369 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaagccctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1370 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEALSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1371 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1372 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1373 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1374 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1375 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatgccacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1376 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYATLVIDGVTPNMIDYFGRPYEGIAVFDGKKITVTGTLWNGNKIIDERLINPDGSLLFRVTINV

SEQ ID NO: 1377 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacgccgttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1378 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDAVTPNMIDYFGRPYEGIAVFDGKKITVTGTLWNGNKIIDERLINPDGSLLFRVTINV

SEQ ID NO: 1379 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcgcccggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1380 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFARPYEGIAVFDGKKITVTGTLWNGNKIIDERLINPDGSLLFRVTINV

SEQ ID NO: 1381 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaagccatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1382 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEAIAVFDGKKITVTGTLWNGNKIIDERLINPDGSLLFRVTINV

SEQ ID NO: 1383 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacgccaaaaagatcactgtaacagggaccctgtggaacggcaacaaaattatcgacgagcgcctgatcaaccccgacggctccctgctgttccgagtaaccatcaacgtt

SEQ ID NO: 1384 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDAKKITVTGTLWNGNKIIDERLINPDGSLLFRVTINV

SEQ ID NO: 1385 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagccaccctgtggaacggcaacaaaattatcgacgagcgcctgatcaaccccgacggctccctgctgttccgagtaaccatcaacgtt

SEQ ID NO: 1386 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTATLWNGNKIIDERLINPDGSLLFRVTINV

SEQ ID NO: 1387 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacgccaacaaaattatcgacgagcgcctgatcaaccccgacggctccctgctgttccgagtaaccatcaacgtt

SEQ ID NO: 1388 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNANKIIDERLINPDGSLLFRVTINV

SEQ ID NO: 1389 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacgcctccctgctgttccgagtaaccatcaacgtt

SEQ ID NO: 1390 - protein, 158 aa, Artificial Sequence
  Synthetic
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDASLLFRVTINV

SEQ ID NO: 1391 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaaggccgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1392 - protein, 158 aa, Artificial Sequence
  Synthetic
VFTLEDFVGDWRQTAGYNLDQVLEQGGVSSLFQNLGVSVTPIQRIVLSGENGLKADIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1393 - DNA, 474 bp, Artificial Sequence
  Synthetic
gtcttcacactcgaagatttcgttggggactggcgacagacagccgcctacaacctggcccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1394 - protein, 158 aa, Artificial Sequence
  Synthetic
VFTLEDFVGDWRQTAAYNLAQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1395 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgggctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1396 - protein, 158 aa, Artificial Sequence
  Synthetic
VFTLEDFVGDWRQTAAYNLDQVLEQGGVSSLFQNLAVSVTPIQRIVLSGENGLKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1397 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1398 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1399 - DNA, 474 bp, Artificial Sequence
  Synthetic
gtcttcacactcgaagatttcgttggggactggcgacagacagccggctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1400 - protein, 158 aa, Artificial Sequence
  Synthetic
VFTLEDFVGDWRQTAGYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1401 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1402 - protein, 158 aa, Artificial Sequence
  Synthetic
VFTLEDFVGDWRQTAAYNLDQVLEQGGVSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1403 - DNA, 474 bp, Artificial Sequence; identical to SEQ ID NO: 1395
  Synthetic

SEQ ID NO: 1404 - protein, 158 aa, Artificial Sequence; identical to SEQ ID NO: 1396
  Synthetic

SEQ ID NO: 1405 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcggcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1406 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSGDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1407 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1408 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMGQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1409 - DNA, 474 bp, Artificial Sequence
  Synthetic
gtcttcacactcgaagatttcgttggggactgggcccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1410 - protein, 158 aa, Artificial Sequence
  Synthetic
VFTLEDFVGDWAQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1411 - DNA, 474 bp, Artificial Sequence
  Synthetic
gtcttcacactcgaagatttcgttggggactggtgccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1412 - protein, 158 aa, Artificial Sequence
  Synthetic
VFTLEDFVGDWCQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1413 - DNA, 474 bp, Artificial Sequence
  Synthetic
gtcttcacactcgaagatttcgttggggactgggaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1414 - protein, 158 aa, Artificial Sequence
  Synthetic
VFTLEDFVGDWDQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1415 - DNA, 474 bp, Artificial Sequence
  Synthetic
gtcttcacactcgaagatttcgttggggactgggagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1416 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1417 - DNA, 474 bp, Artificial Sequence
  Synthetic
gtcttcacactcgaagatttcgttggggactggttccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1418 - protein, 158 aa, Artificial Sequence
  Synthetic
VFTLEDFVGDWFQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1419 - DNA, 474 bp, Artificial Sequence
  Synthetic
gtcttcacactcgaagatttcgttggggactggggccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1420 - protein, 158 aa, Artificial Sequence
  Synthetic
VFTLEDFVGDWGQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1421 - DNA, 474 bp, Artificial Sequence
  Synthetic
gtcttcacactcgaagatttcgttggggactggcaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1422 - protein, 158 aa, Artificial Sequence
  Synthetic
VFTLEDFVGDWHQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1423 - DNA, 474 bp, Artificial Sequence
  Synthetic
gtcttcacactcgaagatttcgttggggactggatccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1424 - protein, 158 aa, Artificial Sequence
  Synthetic
VFTLEDFVGDWIQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1425 - DNA, 474 bp, Artificial Sequence
  Synthetic
gtcttcacactcgaagatttcgttggggactggaagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1426 - protein, 158 aa, Artificial Sequence
  Synthetic
VFTLEDFVGDWKQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1427 - DNA, 474 bp, Artificial Sequence
  Synthetic
gtcttcacactcgaagatttcgttggggactggctgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1428 - protein, 158 aa, Artificial Sequence
  Synthetic
VFTLEDFVGDWLQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1429 - DNA, 474 bp, Artificial Sequence
  Synthetic
gtcttcacactcgaagatttcgttggggactggatgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1430 - protein, 158 aa, Artificial Sequence
  Synthetic
VFTLEDFVGDWMQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1431 - DNA, 474 bp, Artificial Sequence
  Synthetic
gtcttcacactcgaagatttcgttggggactggaaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1432 - protein, 158 aa, Artificial Sequence
  Synthetic
VFTLEDFVGDWNQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1433 - DNA, 474 bp, Artificial Sequence
  Synthetic
gtcttcacactcgaagatttcgttggggactggccccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1434 - protein, 158 aa, Artificial Sequence
  Synthetic
VFTLEDFVGDWPQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1435 - DNA, 474 bp, Artificial Sequence
  Synthetic
gtcttcacactcgaagatttcgttggggactggcagcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1436 - protein, 158 aa, Artificial Sequence
  Synthetic
VFTLEDFVGDWQQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1437 - DNA, 474 bp, Artificial Sequence
  Synthetic
gtcttcacactcgaagatttcgttggggactggagccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1438 - protein, 158 aa, Artificial Sequence
  Synthetic
VFTLEDFVGDWSQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1439 - DNA, 474 bp, Artificial Sequence
  Synthetic
gtcttcacactcgaagatttcgttggggactggacccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1440 - protein, 158 aa, Artificial Sequence
  Synthetic
VFTLEDFVGDWTQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1441 - DNA, 474 bp, Artificial Sequence
  Synthetic
gtcttcacactcgaagatttcgttggggactgggtgcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1442 - protein, 158 aa, Artificial Sequence
  Synthetic
VFTLEDFVGDWVQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1443 - DNA, 474 bp, Artificial Sequence
  Synthetic
gtcttcacactcgaagatttcgttggggactggtggcagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1444 - protein, 158 aa, Artificial Sequence
  Synthetic
VFTLEDFVGDWWQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1445 - DNA, 474 bp, Artificial Sequence
  Synthetic
gtcttcacactcgaagatttcgttggggactggtaccagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1446 - protein, 158 aa, Artificial Sequence
  Synthetic
VFTLEDFVGDWYQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1447 - DNA, 474 bp, Artificial Sequence
  Synthetic
gtcttcacactcgaagatttcgttggggactggcgacagacagcctgctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1448 - protein, 158 aa, Artificial Sequence
  Synthetic
VFTLEDFVGDWRQTACYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1449 - DNA, 474 bp, Artificial Sequence
  Synthetic
gtcttcacactcgaagatttcgttggggactggcgacagacagccgactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1450 - protein, 158 aa, Artificial Sequence
  Synthetic
VFTLEDFVGDWRQTADYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1451 - DNA, 474 bp, Artificial Sequence
  Synthetic
gtcttcacactcgaagatttcgttggggactggcgacagacagccgagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1452 - protein, 158 aa, Artificial Sequence
  Synthetic
VFTLEDFVGDWRQTAEYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1453 - DNA, 474 bp, Artificial Sequence
  Synthetic
gtcttcacactcgaagatttcgttggggactggcgacagacagccttctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1454 - protein, 158 aa, Artificial Sequence
  Synthetic
VFTLEDFVGDWRQTAFYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1455 - DNA, 474 bp, Artificial Sequence; identical to SEQ ID NO: 1399
  Synthetic

SEQ ID NO: 1456 - protein, 158 aa, Artificial Sequence; identical to SEQ ID NO: 1400
  Synthetic

SEQ ID NO: 1457 - DNA, 474 bp, Artificial Sequence
  Synthetic
gtcttcacactcgaagatttcgttggggactggcgacagacagcccactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1458 - protein, 158 aa, Artificial Sequence
  Synthetic
VFTLEDFVGDWRQTAHYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1459 - DNA, 474 bp, Artificial Sequence
  Synthetic
gtcttcacactcgaagatttcgttggggactggcgacagacagccatctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1460 - protein, 158 aa, Artificial Sequence
  Synthetic
VFTLEDFVGDWRQTAIYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1461 - DNA, 474 bp, Artificial Sequence
  Synthetic
gtcttcacactcgaagatttcgttggggactggcgacagacagccaagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1462 - protein, 158 aa, Artificial Sequence
  Synthetic
VFTLEDFVGDWRQTAKYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1463 - DNA, 474 bp, Artificial Sequence
  Synthetic
gtcttcacactcgaagatttcgttggggactggcgacagacagccctgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1464 - protein, 158 aa, Artificial Sequence
  Synthetic
VFTLEDFVGDWRQTALYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1465 - DNA, 474 bp, Artificial Sequence
  Synthetic
gtcttcacactcgaagatttcgttggggactggcgacagacagccatgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1466 - protein, 158 aa, Artificial Sequence
  Synthetic
VFTLEDFVGDWRQTAMYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1467 - DNA, 474 bp, Artificial Sequence
  Synthetic
gtcttcacactcgaagatttcgttggggactggcgacagacagccaactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1468 - protein, 158 aa, Artificial Sequence
  Synthetic
VFTLEDFVGDWRQTANYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1469 - DNA, 474 bp, Artificial Sequence
  Synthetic
gtcttcacactcgaagatttcgttggggactggcgacagacagccccctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1470 - protein, 158 aa, Artificial Sequence
  Synthetic
VFTLEDFVGDWRQTAPYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1471 - DNA, 474 bp, Artificial Sequence
  Synthetic
gtcttcacactcgaagatttcgttggggactggcgacagacagcccagtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1472 - protein, 158 aa, Artificial Sequence
  Synthetic
VFTLEDFVGDWRQTAQYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1473 - DNA, 474 bp, Artificial Sequence
  Synthetic
gtcttcacactcgaagatttcgttggggactggcgacagacagcccggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1474 - protein, 158 aa, Artificial Sequence
  Synthetic
VFTLEDFVGDWRQTARYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1475 - DNA, 474 bp, Artificial Sequence
  Synthetic
gtcttcacactcgaagatttcgttggggactggcgacagacagccagctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1476 - protein, 158 aa, Artificial Sequence
  Synthetic
VFTLEDFVGDWRQTASYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1477 - DNA, 474 bp, Artificial Sequence
  Synthetic
gtcttcacactcgaagatttcgttggggactggcgacagacagccacctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1478 - protein, 158 aa, Artificial Sequence
  Synthetic
VFTLEDFVGDWRQTATYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1479 - DNA, 474 bp, Artificial Sequence
  Synthetic
gtcttcacactcgaagatttcgttggggactggcgacagacagccgtgtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1480 - protein, 158 aa, Artificial Sequence
  Synthetic
VFTLEDFVGDWRQTAVYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1481 - DNA, 474 bp, Artificial Sequence
  Synthetic
gtcttcacactcgaagatttcgttggggactggcgacagacagcctggtacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1482 - protein, 158 aa, Artificial Sequence
  Synthetic
VFTLEDFVGDWRQTAWYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1483 - DNA, 474 bp, Artificial Sequence
  Synthetic
gtcttcacactcgaagatttcgttggggactggcgacagacagcctactacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1484 - protein, 158 aa, Artificial Sequence
  Synthetic
VFTLEDFVGDWRQTAYYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1485 - DNA, 474 bp, Artificial Sequence
  Synthetic
gtcttcacactcgaagatttcgttggggactggcgacagacagccgcctacaacgccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1486 - protein, 158 aa, Artificial Sequence
  Synthetic
VFTLEDFVGDWRQTAAYNADQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1487 - DNA, 474 bp, Artificial Sequence
  Synthetic
gtcttcacactcgaagatttcgttggggactggcgacagacagccgcctacaactgcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1488 - protein, 158 aa, Artificial Sequence
  Synthetic
VFTLEDFVGDWRQTAAYNCDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1489 - DNA, 474 bp, Artificial Sequence
  Synthetic
gtcttcacactcgaagatttcgttggggactggcgacagacagccgcctacaacgacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1490 - protein, 158 aa, Artificial Sequence
  Synthetic
VFTLEDFVGDWRQTAAYNDDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1491 - DNA, 474 bp, Artificial Sequence
  Synthetic
gtcttcacactcgaagatttcgttggggactggcgacagacagccgcctacaacgaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1492 - protein, 158 aa, Artificial Sequence
  Synthetic
VFTLEDFVGDWRQTAAYNEDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1493 - DNA, 474 bp, Artificial Sequence
  Synthetic
gtcttcacactcgaagatttcgttggggactggcgacagacagccgcctacaacttcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1494 - protein, 158 aa, Artificial Sequence
  Synthetic
VFTLEDFVGDWRQTAAYNFDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1495 - DNA, 474 bp, Artificial Sequence
  Synthetic
gtcttcacactcgaagatttcgttggggactggcgacagacagccgcctacaacggcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1496 - protein, 158 aa, Artificial Sequence
  Synthetic
VFTLEDFVGDWRQTAAYNGDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1497 - DNA, 474 bp, Artificial Sequence
  Synthetic
gtcttcacactcgaagatttcgttggggactggcgacagacagccgcctacaaccacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1498 - protein, 158 aa, Artificial Sequence
  Synthetic
VFTLEDFVGDWRQTAAYNHDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1499 - DNA, 474 bp, Artificial Sequence
  Synthetic
gtcttcacactcgaagatttcgttggggactggcgacagacagccgcctacaacatcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1500 - protein, 158 aa, Artificial Sequence
  Synthetic
VFTLEDFVGDWRQTAAYNIDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1501 - DNA, 474 bp, Artificial Sequence
  Synthetic
gtcttcacactcgaagatttcgttggggactggcgacagacagccgcctacaacaaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1502 - protein, 158 aa, Artificial Sequence
  Synthetic
VFTLEDFVGDWRQTAAYNKDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1503 - DNA, 474 bp, Artificial Sequence
  Synthetic
gtcttcacactcgaagatttcgttggggactggcgacagacagccgcctacaacatggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1504 - protein, 158 aa, Artificial Sequence
  Synthetic
VFTLEDFVGDWRQTAAYNMDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1505 - DNA, 474 bp, Artificial Sequence
  Synthetic
gtcttcacactcgaagatttcgttggggactggcgacagacagccgcctacaacaacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1506 - protein, 158 aa, Artificial Sequence
  Synthetic
VFTLEDFVGDWRQTAAYNNDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1507 - DNA, 474 bp, Artificial Sequence
  Synthetic
gtcttcacactcgaagatttcgttggggactggcgacagacagccgcctacaaccccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1508 - protein, 158 aa, Artificial Sequence
  Synthetic
VFTLEDFVGDWRQTAAYNPDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1509 - DNA, 474 bp, Artificial Sequence
  Synthetic
gtcttcacactcgaagatttcgttggggactggcgacagacagccgcctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1510 - protein, 158 aa, Artificial Sequence
  Synthetic
VFTLEDFVGDWRQTAAYNQDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1511 - DNA, 474 bp, Artificial Sequence
  Synthetic
gtcttcacactcgaagatttcgttggggactggcgacagacagccgcctacaaccgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1512 - protein, 158 aa, Artificial Sequence
  Synthetic
VFTLEDFVGDWRQTAAYNRDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1513 - DNA, 474 bp, Artificial Sequence
  Synthetic
gtcttcacactcgaagatttcgttggggactggcgacagacagccgcctacaacagcgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1514 - protein, 158 aa, Artificial Sequence
  Synthetic
VFTLEDFVGDWRQTAAYNSDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1515 - DNA, 474 bp, Artificial Sequence
  Synthetic
gtcttcacactcgaagatttcgttggggactggcgacagacagccgcctacaacaccgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1516 - protein, 158 aa, Artificial Sequence
  Synthetic
VFTLEDFVGDWRQTAAYNTDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1517 - DNA, 474 bp, Artificial Sequence
  Synthetic
gtcttcacactcgaagatttcgttggggactggcgacagacagccgcctacaacgtggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1518 - protein, 158 aa, Artificial Sequence
  Synthetic
VFTLEDFVGDWRQTAAYNVDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1519 - DNA, 474 bp, Artificial Sequence
  Synthetic
gtcttcacactcgaagatttcgttggggactggcgacagacagccgcctacaactgggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1520 - protein, 158 aa, Artificial Sequence
  Synthetic
VFTLEDFVGDWRQTAAYNWDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1521 - DNA, 474 bp, Artificial Sequence
  Synthetic
gtcttcacactcgaagatttcgttggggactggcgacagacagccgcctacaactacgaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1522 - protein, 158 aa, Artificial Sequence
  Synthetic
VFTLEDFVGDWRQTAAYNYDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1523 - DNA, 474 bp, Artificial Sequence
  Synthetic
gtcttcacactcgaagatttcgttggggactggcgacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1524 - protein, 158 aa, Artificial Sequence
  Synthetic
VFTLEDFVGDWRQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1525 - DNA, 474 bp, Artificial Sequence
  Synthetic
gtcttcacactcgaagatttcgttggggactggcgacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1526 - protein, 158 aa, Artificial Sequence
  Synthetic
VFTLEDFVGDWRQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1527 - DNA, 474 bp, Artificial Sequence
  Synthetic
gtcttcacactcgaagatttcgttggggactggcgacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1528 - protein, 158 aa, Artificial Sequence
  Synthetic
VFTLEDFVGDWRQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1529 - DNA, 474 bp, Artificial Sequence
  Synthetic
gtcttcacactcgaagatttcgttggggactggcgacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1530 - protein, 158 aa, Artificial Sequence
  Synthetic
VFTLEDFVGDWRQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1531 - DNA, 474 bp, Artificial Sequence
  Synthetic
gtcttcacactcgaagatttcgttggggactggcgacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1532 - protein, 158 aa, Artificial Sequence
  Synthetic
VFTLEDFVGDWRQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1533 - DNA, 474 bp, Artificial Sequence
  Synthetic
gtcttcacactcgaagatttcgttggggactggcgacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1534 - protein, 158 aa, Artificial Sequence
  Synthetic
VFTLEDFVGDWRQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1535 - DNA, 474 bp, Artificial Sequence
  Synthetic
gtcttcacactcgaagatttcgttggggactggcgacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1536 - protein, 158 aa, Artificial Sequence
  Synthetic
VFTLEDFVGDWRQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1537 - DNA, 474 bp, Artificial Sequence
  Synthetic
gtcttcacactcgaagatttcgttggggactggcgacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1538 - protein, 158 aa, Artificial Sequence
  Synthetic
VFTLEDFVGDWRQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1539 - DNA, 474 bp, Artificial Sequence
  Synthetic
gtcttcacactcgaagatttcgttggggactggcgacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1540 - protein, 158 aa, Artificial Sequence
  Synthetic
VFTLEDFVGDWRQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1541 - DNA, 474 bp, Artificial Sequence
  Synthetic
gtcttcacactcgaagatttcgttggggactggcgacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1542 - protein, 158 aa, Artificial Sequence
  Synthetic
VFTLEDFVGDWRQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1543 - DNA, 474 bp, Artificial Sequence
  Synthetic
gtcttcacactcgaagatttcgttggggactggcgacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1544 - protein, 158 aa, Artificial Sequence
  Synthetic
VFTLEDFVGDWRQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1545 - DNA, 474 bp, Artificial Sequence
  Synthetic
gtcttcacactcgaagatttcgttggggactggcgacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1546 - protein, 158 aa, Artificial Sequence
  Synthetic
VFTLEDFVGDWRQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1547 - DNA, 474 bp, Artificial Sequence
  Synthetic
gtcttcacactcgaagatttcgttggggactggcgacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1548 - protein, 158 aa, Artificial Sequence
  Synthetic
VFTLEDFVGDWRQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1549 - DNA, 474 bp, Artificial Sequence
  Synthetic
gtcttcacactcgaagatttcgttggggactggcgacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1550 - protein, 158 aa, Artificial Sequence
  Synthetic
VFTLEDFVGDWRQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1551 - DNA, 474 bp, Artificial Sequence
  Synthetic
gtcttcacactcgaagatttcgttggggactggcgacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1552 - protein, 158 aa, Artificial Sequence
  Synthetic
VFTLEDFVGDWRQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1553 - DNA, 474 bp, Artificial Sequence
  Synthetic
gtcttcacactcgaagatttcgttggggactggcgacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1554 - protein, 158 aa, Artificial Sequence
  Synthetic
VFTLEDFVGDWRQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1555 - DNA, 474 bp, Artificial Sequence
  Synthetic
gtcttcacactcgaagatttcgttggggactggcgacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1556 - protein, 158 aa, Artificial Sequence
  Synthetic
VFTLEDFVGDWRQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1557 - DNA, 474 bp, Artificial Sequence
  Synthetic
gtcttcacactcgaagatttcgttggggactggcgacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1558 - protein, 158 aa, Artificial Sequence
  Synthetic
VFTLEDFVGDWRQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1559 - DNA, 474 bp, Artificial Sequence
  Synthetic
gtcttcacactcgaagatttcgttggggactggcgacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1560 - protein, 158 aa, Artificial Sequence
  Synthetic
VFTLEDFVGDWRQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1561 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1562 - protein, 158 aa, Artificial Sequence
  Synthetic
VFTLEDFVGDWRQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1563 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattgcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1564 - protein, 158 aa, Artificial Sequence
  Synthetic
VFTLEDFVGDWRQTAAYNLDQVLEQGGVSSLFQNLAVSVTPIQRIVLSGENALKIDIHCIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1565 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1566 - protein, 158 aa, Artificial Sequence
  Synthetic
VFTLEDFVGDWRQTAAYNLDQVLEQGGVSSLFQNLAVSVTPIQRIVLSGENALKIDIHDIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1567 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1568 - protein, 158 aa, Artificial Sequence
  Synthetic
VFTLEDFVGDWRQTAAYNLDQVLEQGGVSSLFQNLAVSVTPIQRIVLSGENALKIDIHEIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1569 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatttcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1570 - protein, 158 aa, Artificial Sequence
  Synthetic
VFTLEDFVGDWRQTAAYNLDQVLEQGGVSSLFQNLAVSVTPIQRIVLSGENALKIDIHFIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1571 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatggcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1572 - protein, 158 aa, Artificial Sequence
  Synthetic
VFTLEDFVGDWRQTAAYNLDQVLEQGGVSSLFQNLAVSVTPIQRIVLSGENALKIDIHGIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1573 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1574 - protein, 158 aa, Artificial Sequence
  Synthetic
VFTLEDFVGDWRQTAAYNLDQVLEQGGVSSLFQNLAVSVTPIQRIVLSGENALKIDIHHIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1575 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1576 - protein, 158 aa, Artificial Sequence
  Synthetic
VFTLEDFVGDWRQTAAYNLDQVLEQGGVSSLFQNLAVSVTPIQRIVLSGENALKIDIHIIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1577 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1578 - protein, 158 aa, Artificial Sequence
  Synthetic
VFTLEDFVGDWRQTAAYNLDQVLEQGGVSSLFQNLAVSVTPIQRIVLSGENALKIDIHKIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1579 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatctgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1580 - protein, 158 aa, Artificial Sequence
  Synthetic
VFTLEDFVGDWRQTAAYNLDQVLEQGGVSSLFQNLAVSVTPIQRIVLSGENALKIDIHLIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1581 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatatgatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1582 - protein, 158 aa, Artificial Sequence
  Synthetic
VFTLEDFVGDWRQTAAYNLDQVLEQGGVSSLFQNLAVSVTPIQRIVLSGENALKIDIHMIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1583 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1584 - protein, 158 aa, Artificial Sequence
  Synthetic
VFTLEDFVGDWRQTAAYNLDQVLEQGGVSSLFQNLAVSVTPIQRIVLSGENALKIDIHNIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1585 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1586 - protein, 158 aa, Artificial Sequence
  Synthetic
VFTLEDFVGDWRQTAAYNLDQVLEQGGVSSLFQNLAVSVTPIQRIVLSGENALKIDIHPIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1587 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcagatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1588 - protein, 158 aa, Artificial Sequence
  Synthetic
VFTLEDFVGDWRQTAAYNLDQVLEQGGVSSLFQNLAVSVTPIQRIVLSGENALKIDIHQIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1589 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatcggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1590 - protein, 158 aa, Artificial Sequence
  Synthetic
VFTLEDFVGDWRQTAAYNLDQVLEQGGVSSLFQNLAVSVTPIQRIVLSGENALKIDIHRIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1591 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatagcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1592 - protein, 158 aa, Artificial Sequence
  Synthetic
VFTLEDFVGDWRQTAAYNLDQVLEQGGVSSLFQNLAVSVTPIQRIVLSGENALKIDIHSIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1593 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccataccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1594 - protein, 158 aa, Artificial Sequence
  Synthetic
VFTLEDFVGDWRQTAAYNLDQVLEQGGVSSLFQNLAVSVTPIQRIVLSGENALKIDIHTIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1595 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattggatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1596 - protein, 158 aa, Artificial Sequence
  Synthetic
VFTLEDFVGDWRQTAAYNLDQVLEQGGVSSLFQNLAVSVTPIQRIVLSGENALKIDIHWIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1597 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccattacatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1598 - protein, 158 aa, Artificial Sequence
  Synthetic
VFTLEDFVGDWRQTAAYNLDQVLEQGGVSSLFQNLAVSVTPIQRIVLSGENALKIDIHYIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1599 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1600 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSCDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1601 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1602 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSDDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1603 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1604 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSEDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1605 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcttcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1606 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSFDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1607 - DNA, 474 bp, Artificial Sequence; identical to SEQ ID NO: 1405
  Synthetic

SEQ ID NO: 1608 - protein, 158 aa, Artificial Sequence; identical to SEQ ID NO: 1406
  Synthetic

SEQ ID NO: 1609 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1610 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSHDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1611 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1612 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSIDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1613 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1614 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSKDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1615 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcctggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1616 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSLDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1617 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcatggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1618 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSMDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1619 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1620 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSNDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1621 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1622 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSPDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1623 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccaggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1624 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSQDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1625 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagccgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1626 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSRDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1627 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcagcgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1628 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSSDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1629 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcaccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1630 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSTDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1631 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgtggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1632 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSVDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1633 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctgggaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1634 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSWDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1635 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagctacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1636 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSYDQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1637 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1638 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNAIDYFGRPYEGIAVFDGKKITVTGTLWNGNKIIDERLINPDGSLLFRVTINV

SEQ ID NO: 1639 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactgcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1640 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNCIDYFGRPYEGIAVFDGKKITVTGTLWNGNKIIDERLINPDGSLLFRVTINV

SEQ ID NO: 1641 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1642 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNDIDYFGRPYEGIAVFDGKKITVTGTLWNGNKIIDERLINPDGSLLFRVTINV

SEQ ID NO: 1643 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1644 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNEIDYFGRPYEGIAVFDGKKITVTGTLWNGNKIIDERLINPDGSLLFRVTINV

SEQ ID NO: 1645 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacttcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1646 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNFIDYFGRPYEGIAVFDGKKITVTGTLWNGNKIIDERLINPDGSLLFRVTINV

SEQ ID NO: 1647 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacggcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1648 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNGIDYFGRPYEGIAVFDGKKITVTGTLWNGNKIIDERLINPDGSLLFRVTINV

SEQ ID NO: 1649 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1650 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNHIDYFGRPYEGIAVFDGKKITVTGTLWNGNKIIDERLINPDGSLLFRVTINV

SEQ ID NO: 1651 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1652 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNIIDYFGRPYEGIAVFDGKKITVTGTLWNGNKIIDERLINPDGSLLFRVTINV

SEQ ID NO: 1653 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1654 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNKIDYFGRPYEGIAVFDGKKITVTGTLWNGNKIIDERLINPDGSLLFRVTINV

SEQ ID NO: 1655 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacctgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1656 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNLIDYFGRPYEGIAVFDGKKITVTGTLWNGNKIIDERLINPDGSLLFRVTINV

SEQ ID NO: 1657 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1658 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNNIDYFGRPYEGIAVFDGKKITVTGTLWNGNKIIDERLINPDGSLLFRVTINV

SEQ ID NO: 1659 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1660 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNPIDYFGRPYEGIAVFDGKKITVTGTLWNGNKIIDERLINPDGSLLFRVTINV

SEQ ID NO: 1661 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccagatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1662 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNQIDYFGRPYEGIAVFDGKKITVTGTLWNGNKIIDERLINPDGSLLFRVTINV

SEQ ID NO: 1663 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaaccggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1664 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNRIDYFGRPYEGIAVFDGKKITVTGTLWNGNKIIDERLINPDGSLLFRVTINV

SEQ ID NO: 1665 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacagcatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1666 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNSIDYFGRPYEGIAVFDGKKITVTGTLWNGNKIIDERLINPDGSLLFRVTINV

SEQ ID NO: 1667 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacaccatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1668 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNTIDYFGRPYEGIAVFDGKKITVTGTLWNGNKIIDERLINPDGSLLFRVTINV

SEQ ID NO: 1669 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1670 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSLLFRVTINV

SEQ ID NO: 1671 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactggatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1672 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNWIDYFGRPYEGIAVFDGKKITVTGTLWNGNKIIDERLINPDGSLLFRVTINV

SEQ ID NO: 1673 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaactacatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1674 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNYIDYFGRPYEGIAVFDGKKITVTGTLWNGNKIIDERLINPDGSLLFRVTINV

SEQ ID NO: 1675 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgccctgttccgagtaaccatcaacgtt

SEQ ID NO: 1676 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSALFRVTINV

SEQ ID NO: 1677 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctgcctgttccgagtaaccatcaacgtt

SEQ ID NO: 1678 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSCLFRVTINV

SEQ ID NO: 1679 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgacctgttccgagtaaccatcaacgtt

SEQ ID NO: 1680 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSDLFRVTINV

SEQ ID NO: 1681 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgagctgttccgagtaaccatcaacgtt

SEQ ID NO: 1682 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSELFRVTINV

SEQ ID NO: 1683 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccttcctgttccgagtaaccatcaacgtt

SEQ ID NO: 1684 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSFLFRVTINV

SEQ ID NO: 1685 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccggcctgttccgagtaaccatcaacgtt

SEQ ID NO: 1686 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSGLFRVTINV

SEQ ID NO: 1687 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccacctgttccgagtaaccatcaacgtt

SEQ ID NO: 1688 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSHLFRVTINV

SEQ ID NO: 1689 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatcctgttccgagtaaccatcaacgtt

SEQ ID NO: 1690 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSILFRVTINV

SEQ ID NO: 1691 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaagctgttccgagtaaccatcaacgtt

SEQ ID NO: 1692 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSKLFRVTINV

SEQ ID NO: 1693 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1694 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1695 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaacctgttccgagtaaccatcaacgtt

SEQ ID NO: 1696 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSNLFRVTINV

SEQ ID NO: 1697 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccccctgttccgagtaaccatcaacgtt

SEQ ID NO: 1698 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSPLFRVTINV

SEQ ID NO: 1699 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccagctgttccgagtaaccatcaacgtt

SEQ ID NO: 1700 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSQLFRVTINV

SEQ ID NO: 1701 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcccggctgttccgagtaaccatcaacgtt

SEQ ID NO: 1702 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSRLFRVTINV

SEQ ID NO: 1703 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccagcctgttccgagtaaccatcaacgtt

SEQ ID NO: 1704 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSSLFRVTINV

SEQ ID NO: 1705 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccaccctgttccgagtaaccatcaacgtt

SEQ ID NO: 1706 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSTLFRVTINV

SEQ ID NO: 1707 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccgtgctgttccgagtaaccatcaacgtt

SEQ ID NO: 1708 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSVLFRVTINV

SEQ ID NO: 1709 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctggctgttccgagtaaccatcaacgtt

SEQ ID NO: 1710 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSWLFRVTINV

SEQ ID NO: 1711 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctcctacctgttccgagtaaccatcaacgtt

SEQ ID NO: 1712 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSYLFRVTINV

SEQ ID NO: 1713 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgcc

SEQ ID NO: 1714 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINA

SEQ ID NO: 1715 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgc

SEQ ID NO: 1716 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINC

SEQ ID NO: 1717 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 1718 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTIND

SEQ ID NO: 1719 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgag

SEQ ID NO: 1720 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINE

SEQ ID NO: 1721 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacttc

SEQ ID NO: 1722 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINF

SEQ ID NO: 1723 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggc

SEQ ID NO: 1724 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTING

SEQ ID NO: 1725 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccac

SEQ ID NO: 1726 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINH

SEQ ID NO: 1727 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatc

SEQ ID NO: 1728 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINI

SEQ ID NO: 1729 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaag

SEQ ID NO: 1730 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINK

SEQ ID NO: 1731 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacctg

SEQ ID NO: 1732 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINL

SEQ ID NO: 1733 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacatg

SEQ ID NO: 1734 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINM

SEQ ID NO: 1735 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacaac

SEQ ID NO: 1736 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINN

SEQ ID NO: 1737 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 1738 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 1739 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccag

SEQ ID NO: 1740 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINQ

SEQ ID NO: 1741 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaaccgg

SEQ ID NO: 1742 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINR

SEQ ID NO: 1743 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacagc

SEQ ID NO: 1744 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINS

SEQ ID NO: 1745 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacacc

SEQ ID NO: 1746 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINT

SEQ ID NO: 1747 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactgg

SEQ ID NO: 1748 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINW

SEQ ID NO: 1749 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaactac

SEQ ID NO: 1750 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINY

SEQ ID NO: 1751 - DNA, 474 bp, Artificial Sequence
  Synthetic
gtcttcacactcgaagatttcgttggggactggcgacagacagccgcctacaacctggacaaggtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1752 - protein, 158 aa, Artificial Sequence
  Synthetic
VFTLEDFVGDWRQTAAYNLDKVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1753 - DNA, 474 bp, Artificial Sequence
  Synthetic
gtcttcacactcgaagatttcgttggggactggcgacagacagccgcctacaacctggaccaagtccttgaacagggaggtatgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1754 - protein, 158 aa, Artificial Sequence
  Synthetic
VFTLEDFVGDWRQTAAYNLDQVLEQGGMSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1755 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaagctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1756 - protein, 158 aa, Artificial Sequence
  Synthetic
VFTLEDFVGDWRQTAAYNLDQVLEQGGVSSLFQKLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1757 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccatcactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1758 - protein, 158 aa, Artificial Sequence
  Synthetic
VFTLEDFVGDWRQTAAYNLDQVLEQGGVSSLFQNLAVSITPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1759 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1760 - protein, 158 aa, Artificial Sequence
  Synthetic
VFTLEDFVGDWRQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1761 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1762 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSLLFRVTINV

SEQ ID NO: 1763 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1764 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSLLFRVTINV

SEQ ID NO: 1765 - DNA, 474 bp, Artificial Sequence
  Synthetic
gtcttcacactcgaagatttcgttggggactggcgacagacagccgcctacaacctggaccaagtccttgaacagggaggtatgtccagtttgtttcagaatctcggggtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1766 - protein, 158 aa, Artificial Sequence
  Synthetic
VFTLEDFVGDWRQTAAYNLDQVLEQGGMSSLFQNLGVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINV

SEQ ID NO: 1767 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatgggccagatcgaagagatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgtt

SEQ ID NO: 1768 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMGQIEEIFKVVYPVDDHHFKVILHYGTLVIDGVTPNMIDYFGRPYEGIAVFDGKKITVTGTLWNGNKIIDERLINPDGSLLFRVTINV

SEQ ID NO: 1769 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1770 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINV

SEQ ID NO: 1771 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacccc

SEQ ID NO: 1772 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSLLFRVTINP

SEQ ID NO: 1773 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccctgctgttccgagtaaccatcaacgtt

SEQ ID NO: 1774 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSLLFRVTINV

SEQ ID NO: 1775 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1776 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 1777 - DNA, 474 bp, Artificial Sequence
  Synthetic
gtcttcacactcgaagatttcgttggggactggcgacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1778 - protein, 158 aa, Artificial Sequence
  Synthetic
VFTLEDFVGDWRQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 1779 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1780 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINP

SEQ ID NO: 1781 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacccc

SEQ ID NO: 1782 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINP

SEQ ID NO: 1783 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1784 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINP

SEQ ID NO: 1785 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 1786 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLINPDGSMLFRVTINE

SEQ ID NO: 1787 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgag

SEQ ID NO: 1788 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLINPDGSMLFRVTINE

SEQ ID NO: 1789 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1790 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIDYFGRPYEGIAVFDGKKITVTGTLWNGNKIIDERLITPDGSMLFRVTINE

SEQ ID NO: 1791 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1792 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1793 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1794 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1795 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1796 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 1797 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgag

SEQ ID NO: 1798 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINE

SEQ ID NO: 1799 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1800 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1801 - DNA, 474 bp, Artificial Sequence
  Synthetic
gtcttcacactcgaagatttcgttggggactggcgacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1802 - protein, 158 aa, Artificial Sequence
  Synthetic
VFTLEDFVGDWRQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1803 - DNA, 474 bp, Artificial Sequence
  Synthetic
gtcttcacactcgaagatttcgttggggactggcaacagacagccgcctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1804 - protein, 158 aa, Artificial Sequence
  Synthetic
VFTLEDFVGDWNQTAAYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1805 - DNA, 474 bp, Artificial Sequence
  Synthetic
gtcttcacactcgaagatttcgttggggactggcaacagacagccagctacaacctggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1806 - protein, 158 aa, Artificial Sequence
  Synthetic
VFTLEDFVGDWNQTASYNLDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1807 - DNA, 474 bp, Artificial Sequence
  Synthetic
gtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1808 - protein, 158 aa, Artificial Sequence
  Synthetic
VFTLEDFVGDWNQTASYNQDQVLEQGGVSSLFQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1809 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1810 - protein, 158 aa, Artificial Sequence
  Synthetic
VFTLEDFVGDWNQTASYNQDQVLEQGGVSSLIQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1811 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1812 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1813 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1814 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNMIDYFGRPYEGIAVFDGKKITVTGTLWNGNKIIDERLINPDGSMLFRVTIND

SEQ ID NO: 1815 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacgac

SEQ ID NO: 1816 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSLLFRVTIND

SEQ ID NO: 1817 - DNA, 474 bp, Artificial Sequence
  Synthetic
gtcttcacactcgaagatttcgttggggactggcaacagacagccagctacaaccaggaccaagtccttgaacagggaggtgtgtccagtttgatacagaatctcgccgtgtccgtaactccgatccaaaggattgtcctgagcggtgaaaatgccctgaagatcgacatccatgccatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgtt

SEQ ID NO: 1818 - protein, 158 aa, Artificial Sequence
  Synthetic
VFTLEDFVGDWNQTASYNQDQVLEQGGVSSLIQNLAVSVTPIQRIVLSGENALKIDIHAIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTINV

SEQ ID NO: 1819 - DNA, 474 bp, Artificial Sequence
  Synthetic
gtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1820 - protein, 158 aa, Artificial Sequence
  Synthetic
VFTLEDFVGDWRQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1821 - DNA, 474 bp, Artificial Sequence
  Synthetic
gtcttcacactcgaagatttcgttggggactggcgacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgacgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1822 - protein, 158 aa, Artificial Sequence
  Synthetic
VFTLEDFVGDWRQTASYNQDQVLEQGGVSSLFQNLAVSVTPIQRIVLSGENALKIDIHVIIPYEGLSDDQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1823 - DNA, 474 bp, Artificial Sequence
  Synthetic
gtcttcacactcgaagatttcgttggggactggcaacagacagccagctacaaccaggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacgtgatcgactatttcggacggccgtatgaaggcatcgccgtgttcgacggcaaaaagatcactgtaacagggaccctgtggaacggcaacaaaattatcgacgagcgcctgatcaaccccgacggctccatgctgttccgagtaaccatcaacgac

SEQ ID NO: 1824 - protein, 158 aa, Artificial Sequence
  Synthetic
VFTLEDFVGDWNQTASYNQDQVLEQGGVSSLFQNLAVSVTPIQRIVLSGENALKIDIHVIIPYEGLSADQMAQIEKIFKVVYPVDDHHFKVILHYGTLVIDGVTPNVIDYFGRPYEGIAVFDGKKITVTGTLWNGNKIIDERLINPDGSMLFRVTIND

SEQ ID NO: 1825 - DNA, 477 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtg

SEQ ID NO: 1826 - protein, 159 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPV

SEQ ID NO: 1827 - DNA, 477 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgcc

SEQ ID NO: 1828 - protein, 159 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPA

SEQ ID NO: 1829 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgacc

SEQ ID NO: 1830 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVT

SEQ ID NO: 1831 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtggcc

SEQ ID NO: 1832 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVA

SEQ ID NO: 1833 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccacc

SEQ ID NO: 1834 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAT

SEQ ID NO: 1835 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccgcc

SEQ ID NO: 1836 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPAA

SEQ ID NO: 1837 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcggc

SEQ ID NO: 1838 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGG

SEQ ID NO: 1839 - DNA, 480 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcacc

SEQ ID NO: 1840 - protein, 160 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGT

SEQ ID NO: 1841 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgccaccggc

SEQ ID NO: 1842 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPATG

SEQ ID NO: 1843 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggc

SEQ ID NO: 1844 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTG

SEQ ID NO: 1845 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccgcc

SEQ ID NO: 1846 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTA

SEQ ID NO: 1847 - DNA, 483 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccggcaccgcc

SEQ ID NO: 1848 - protein, 161 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPGTA

SEQ ID NO: 1849 - DNA, 486 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgg

SEQ ID NO: 1850 - protein, 162 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGW

SEQ ID NO: 1851 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcgg

SEQ ID NO: 1852 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWR

SEQ ID NO: 1853 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctgggag

SEQ ID NO: 1854 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWE

SEQ ID NO: 1855 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggaag

SEQ ID NO: 1856 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWK

SEQ ID NO: 1857 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcag

SEQ ID NO: 1858 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWQ

SEQ ID NO: 1859 - DNA, 489 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccccgtgaccggctggcac

SEQ ID NO: 1860 - protein, 163 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINPVTGWH

SEQ ID NO: 1861 - DNA, 471 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaac

SEQ ID NO: 1862 - protein, 157 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIN

SEQ ID NO: 1863 - DNA, 468 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatc

SEQ ID NO: 1864 - protein, 156 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTI

SEQ ID NO: 1865 - DNA, 465 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaacc

SEQ ID NO: 1866 - protein, 155 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVT

SEQ ID NO: 1867 - DNA, 462 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagta

SEQ ID NO: 1868 - protein, 154 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRV

SEQ ID NO: 1869 - DNA, 459 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccga

SEQ ID NO: 1870 - protein, 153 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFR

SEQ ID NO: 1871 - DNA, 456 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttc

SEQ ID NO: 1872 - protein, 152 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLF

SEQ ID NO: 1873 - DNA, 453 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctg

SEQ ID NO: 1874 - protein, 151 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSML

SEQ ID NO: 1875 - DNA, 474 bp, Artificial Sequence
  Synthetic
gtcttcacactcgaagatttcgttggggactgggaacagacagccgcctacaacctggaccaagtccttgaacagggaggtgtgtccagtttggcccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1876 - protein, 158 aa, Artificial Sequence
  Synthetic
VFTLEDFVGDWEQTAAYNLDQVLEQGGVSSLAQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1877 - DNA, 474 bp, Artificial Sequence
  Synthetic
gtcttcacactcgaagatttcgttggggactgggaacagacagccgcctacaacctggaccaagtccttgaacagggaggtgtgtccagtttgtgccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1878 - protein, 158 aa, Artificial Sequence
  Synthetic
VFTLEDFVGDWEQTAAYNLDQVLEQGGVSSLCQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1879 - DNA, 474 bp, Artificial Sequence
  Synthetic
gtcttcacactcgaagatttcgttggggactgggaacagacagccgcctacaacctggaccaagtccttgaacagggaggtgtgtccagtttggaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1880 - protein, 158 aa, Artificial Sequence
  Synthetic
VFTLEDFVGDWEQTAAYNLDQVLEQGGVSSLDQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1881 - DNA, 474 bp, Artificial Sequence
  Synthetic
gtcttcacactcgaagatttcgttggggactgggaacagacagccgcctacaacctggaccaagtccttgaacagggaggtgtgtccagtttggagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1882 - protein, 158 aa, Artificial Sequence
  Synthetic
VFTLEDFVGDWEQTAAYNLDQVLEQGGVSSLEQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1883 - DNA, 474 bp, Artificial Sequence
  Synthetic
gtcttcacactcgaagatttcgttggggactgggaacagacagccgcctacaacctggaccaagtccttgaacagggaggtgtgtccagtttgggccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1884 - protein, 158 aa, Artificial Sequence
  Synthetic
VFTLEDFVGDWEQTAAYNLDQVLEQGGVSSLGQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1885 - DNA, 474 bp, Artificial Sequence
  Synthetic
gtcttcacactcgaagatttcgttggggactgggaacagacagccgcctacaacctggaccaagtccttgaacagggaggtgtgtccagtttgcaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1886 - protein, 158 aa, Artificial Sequence
  Synthetic
VFTLEDFVGDWEQTAAYNLDQVLEQGGVSSLHQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1887 - DNA, 474 bp, Artificial Sequence
  Synthetic
gtcttcacactcgaagatttcgttggggactgggaacagacagccgcctacaacctggaccaagtccttgaacagggaggtgtgtccagtttgatccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1888 - protein, 158 aa, Artificial Sequence
  Synthetic
VFTLEDFVGDWEQTAAYNLDQVLEQGGVSSLIQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1889 - DNA, 474 bp, Artificial Sequence
  Synthetic
gtcttcacactcgaagatttcgttggggactgggaacagacagccgcctacaacctggaccaagtccttgaacagggaggtgtgtccagtttgaagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1890 - protein, 158 aa, Artificial Sequence
  Synthetic
VFTLEDFVGDWEQTAAYNLDQVLEQGGVSSLKQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1891 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1892 - protein, 158 aa, Artificial Sequence
  Synthetic
VFTLEDFVGDWEQTAAYNLDQVLEQGGVSSLLQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1893 - DNA, 474 bp, Artificial Sequence
  Synthetic
gtcttcacactcgaagatttcgttggggactgggaacagacagccgcctacaacctggaccaagtccttgaacagggaggtgtgtccagtttgatgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1894 - protein, 158 aa, Artificial Sequence
  Synthetic
VFTLEDFVGDWEQTAAYNLDQVLEQGGVSSLMQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1895 - DNA, 474 bp, Artificial Sequence
  Synthetic
gtcttcacactcgaagatttcgttggggactgggaacagacagccgcctacaacctggaccaagtccttgaacagggaggtgtgtccagtttgaaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1896 - protein, 158 aa, Artificial Sequence
  Synthetic
VFTLEDFVGDWEQTAAYNLDQVLEQGGVSSLNQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1897 - DNA, 474 bp, Artificial Sequence
  Synthetic
gtcttcacactcgaagatttcgttggggactgggaacagacagccgcctacaacctggaccaagtccttgaacagggaggtgtgtccagtttgccccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1898 - protein, 158 aa, Artificial Sequence
  Synthetic
VFTLEDFVGDWEQTAAYNLDQVLEQGGVSSLPQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1899 - DNA, 474 bp, Artificial Sequence
  Synthetic
gtcttcacactcgaagatttcgttggggactgggaacagacagccgcctacaacctggaccaagtccttgaacagggaggtgtgtccagtttgcagcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1900 - protein, 158 aa, Artificial Sequence
  Synthetic
VFTLEDFVGDWEQTAAYNLDQVLEQGGVSSLQQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1901 - DNA, 474 bp, Artificial Sequence
  Synthetic
gtcttcacactcgaagatttcgttggggactgggaacagacagccgcctacaacctggaccaagtccttgaacagggaggtgtgtccagtttgcggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1902 - protein, 158 aa, Artificial Sequence
  Synthetic
VFTLEDFVGDWEQTAAYNLDQVLEQGGVSSLRQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1903 - DNA, 474 bp, Artificial Sequence
  Synthetic
gtcttcacactcgaagatttcgttggggactgggaacagacagccgcctacaacctggaccaagtccttgaacagggaggtgtgtccagtttgagccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1904 - protein, 158 aa, Artificial Sequence
  Synthetic
VFTLEDFVGDWEQTAAYNLDQVLEQGGVSSLSQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1905 - DNA, 474 bp, Artificial Sequence
  Synthetic
gtcttcacactcgaagatttcgttggggactgggaacagacagccgcctacaacctggaccaagtccttgaacagggaggtgtgtccagtttgacccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1906 - protein, 158 aa, Artificial Sequence
  Synthetic
VFTLEDFVGDWEQTAAYNLDQVLEQGGVSSLTQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1907 - DNA, 474 bp, Artificial Sequence
  Synthetic
gtcttcacactcgaagatttcgttggggactgggaacagacagccgcctacaacctggaccaagtccttgaacagggaggtgtgtccagtttggtgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1908 - protein, 158 aa, Artificial Sequence
  Synthetic
VFTLEDFVGDWEQTAAYNLDQVLEQGGVSSLVQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1909 - DNA, 474 bp, Artificial Sequence
  Synthetic
gtcttcacactcgaagatttcgttggggactgggaacagacagccgcctacaacctggaccaagtccttgaacagggaggtgtgtccagtttgtggcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1910 - protein, 158 aa, Artificial Sequence
  Synthetic
VFTLEDFVGDWEQTAAYNLDQVLEQGGVSSLWQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1911 - DNA, 474 bp, Artificial Sequence
  Synthetic
gtcttcacactcgaagatttcgttggggactgggaacagacagccgcctacaacctggaccaagtccttgaacagggaggtgtgtccagtttgtaccagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1912 - protein, 158 aa, Artificial Sequence
  Synthetic
VFTLEDFVGDWEQTAAYNLDQVLEQGGVSSLYQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1913 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1914 - protein, 158 aa, Artificial Sequence
  Synthetic
VFTLEDFVGDWEQTAAYNLDQVLEQGGVSSLFQNLAVSVTPIQRIVASGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1915 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctgcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1916 - protein, 158 aa, Artificial Sequence
  Synthetic
VFTLEDFVGDWEQTAAYNLDQVLEQGGVSSLFQNLAVSVTPIQRIVCSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1917 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1918 - protein, 158 aa, Artificial Sequence
  Synthetic
VFTLEDFVGDWEQTAAYNLDQVLEQGGVSSLFQNLAVSVTPIQRIVDSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1919 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1920 - protein, 158 aa, Artificial Sequence
  Synthetic
VFTLEDFVGDWEQTAAYNLDQVLEQGGVSSLFQNLAVSVTPIQRIVESGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1921 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcttcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1922 - protein, 158 aa, Artificial Sequence
  Synthetic
VFTLEDFVGDWEQTAAYNLDQVLEQGGVSSLFQNLAVSVTPIQRIVFSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1923 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcggcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1924 - protein, 158 aa, Artificial Sequence
  Synthetic
VFTLEDFVGDWEQTAAYNLDQVLEQGGVSSLFQNLAVSVTPIQRIVGSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1925 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1926 - protein, 158 aa, Artificial Sequence
  Synthetic
VFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1927 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1928 - protein, 158 aa, Artificial Sequence
  Synthetic
VFTLEDFVGDWEQTAAYNLDQVLEQGGVSSLFQNLAVSVTPIQRIVISGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1929 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1930 - protein, 158 aa, Artificial Sequence
  Synthetic
VFTLEDFVGDWEQTAAYNLDQVLEQGGVSSLFQNLAVSVTPIQRIVKSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1931 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcatgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1932 - protein, 158 aa, Artificial Sequence
  Synthetic
VFTLEDFVGDWEQTAAYNLDQVLEQGGVSSLFQNLAVSVTPIQRIVMSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1933 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1934 - protein, 158 aa, Artificial Sequence
  Synthetic
VFTLEDFVGDWEQTAAYNLDQVLEQGGVSSLFQNLAVSVTPIQRIVNSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1935 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1936 - protein, 158 aa, Artificial Sequence
  Synthetic
VFTLEDFVGDWEQTAAYNLDQVLEQGGVSSLFQNLAVSVTPIQRIVPSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1937 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1938 - protein, 158 aa, Artificial Sequence
  Synthetic
VFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1939 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1940 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1941 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcagcagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1942 - protein, 158 aa, Artificial Sequence
  Synthetic
VFTLEDFVGDWEQTAAYNLDQVLEQGGVSSLFQNLAVSVTPIQRIVSSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1943 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcaccagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1944 - protein, 158 aa, Artificial Sequence
  Synthetic
VFTLEDFVGDWEQTAAYNLDQVLEQGGVSSLFQNLAVSVTPIQRIVTSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1945 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcgtgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1946 - protein, 158 aa, Artificial Sequence
  Synthetic
VFTLEDFVGDWEQTAAYNLDQVLEQGGVSSLFQNLAVSVTPIQRIVVSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1947 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1948 - protein, 158 aa, Artificial Sequence
  Synthetic
VFTLEDFVGDWEQTAAYNLDQVLEQGGVSSLFQNLAVSVTPIQRIVWSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1949 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtctacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1950 - protein, 158 aa, Artificial Sequence
  Synthetic
VFTLEDFVGDWEQTAAYNLDQVLEQGGVSSLFQNLAVSVTPIQRIVYSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 1951 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgcctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1952 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIAYFGRPYEGIAVFDGKKITVTGTLWNGNKIIDERLITPDGSMLFRVTINP

SEQ ID NO: 1953 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctgctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1954 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMICYFGRPYEGIAVFDGKKITVTGTLWNGNKIIDERLITPDGSMLFRVTINP

SEQ ID NO: 1955 - DNA, 474 bp, Artificial Sequence; identical to SEQ ID NO: 1783
  Synthetic

SEQ ID NO: 1956 - protein, 158 aa, Artificial Sequence; identical to SEQ ID NO: 1784
  Synthetic

SEQ ID NO: 1957 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1958 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIEYFGRPYEGIAVFDGKKITVTGTLWNGNKIIDERLITPDGSMLFRVTINP

SEQ ID NO: 1959 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcttctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1960 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIFYFGRPYEGIAVFDGKKITVTGTLWNGNKIIDERLITPDGSMLFRVTINP

SEQ ID NO: 1961 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcggctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1962 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIGYFGRPYEGIAVFDGKKITVTGTLWNGNKIIDERLITPDGSMLFRVTINP

SEQ ID NO: 1963 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1964 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIHYFGRPYEGIAVFDGKKITVTGTLWNGNKIIDERLITPDGSMLFRVTINP

SEQ ID NO: 1965 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1966 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIIYFGRPYEGIAVFDGKKITVTGTLWNGNKIIDERLITPDGSMLFRVTINP

SEQ ID NO: 1967 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1968 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIKYFGRPYEGIAVFDGKKITVTGTLWNGNKIIDERLITPDGSMLFRVTINP

SEQ ID NO: 1969 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcctgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1970 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMILYFGRPYEGIAVFDGKKITVTGTLWNGNKIIDERLITPDGSMLFRVTINP

SEQ ID NO: 1971 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcatgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1972 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIMYFGRPYEGIAVFDGKKITVTGTLWNGNKIIDERLITPDGSMLFRVTINP

SEQ ID NO: 1973 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcccctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1974 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIPYFGRPYEGIAVFDGKKITVTGTLWNGNKIIDERLITPDGSMLFRVTINP

SEQ ID NO: 1975 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccagtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1976 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIQYFGRPYEGIAVFDGKKITVTGTLWNGNKIIDERLITPDGSMLFRVTINP

SEQ ID NO: 1977 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatccggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1978 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIRYFGRPYEGIAVFDGKKITVTGTLWNGNKIIDERLITPDGSMLFRVTINP

SEQ ID NO: 1979 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcagctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1980 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMISYFGRPYEGIAVFDGKKITVTGTLWNGNKIIDERLITPDGSMLFRVTINP

SEQ ID NO: 1981 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcacctatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1982 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMITYFGRPYEGIAVFDGKKITVTGTLWNGNKIIDERLITPDGSMLFRVTINP

SEQ ID NO: 1983 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcgtgtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1984 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIVYFGRPYEGIAVFDGKKITVTGTLWNGNKIIDERLITPDGSMLFRVTINP

SEQ ID NO: 1985 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctggtatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1986 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIWYFGRPYEGIAVFDGKKITVTGTLWNGNKIIDERLITPDGSMLFRVTINP

SEQ ID NO: 1987 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatctactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 1988 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMIYYFGRPYEGIAVFDGKKITVTGTLWNGNKIIDERLITPDGSMLFRVTINP

SEQ ID NO: 1989 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgcccccgacggctccatgctgttccgagtaaccatcaacccc

SEQ ID NO: 1990 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIAPDGSMLFRVTINP

SEQ ID NO: 1991 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctgccccgacggctccatgctgttccgagtaaccatcaacccc

SEQ ID NO: 1992 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLICPDGSMLFRVTINP

SEQ ID NO: 1993 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgaccccgacggctccatgctgttccgagtaaccatcaacccc

SEQ ID NO: 1994 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIDPDGSMLFRVTINP

SEQ ID NO: 1995 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgagcccgacggctccatgctgttccgagtaaccatcaacccc

SEQ ID NO: 1996 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIEPDGSMLFRVTINP

SEQ ID NO: 1997 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcttccccgacggctccatgctgttccgagtaaccatcaacccc

SEQ ID NO: 1998 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIFPDGSMLFRVTINP

SEQ ID NO: 1999 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcggccccgacggctccatgctgttccgagtaaccatcaacccc

SEQ ID NO: 2000 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIGPDGSMLFRVTINP

SEQ ID NO: 2001 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccaccccgacggctccatgctgttccgagtaaccatcaacccc

SEQ ID NO: 2002 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIHPDGSMLFRVTINP

SEQ ID NO: 2003 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatccccgacggctccatgctgttccgagtaaccatcaacccc

SEQ ID NO: 2004 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIIPDGSMLFRVTINP

SEQ ID NO: 2005 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcaagcccgacggctccatgctgttccgagtaaccatcaacccc

SEQ ID NO: 2006 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIKPDGSMLFRVTINP

SEQ ID NO: 2007 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcctgcccgacggctccatgctgttccgagtaaccatcaacccc

SEQ ID NO: 2008 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLILPDGSMLFRVTINP

SEQ ID NO: 2009 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcatgcccgacggctccatgctgttccgagtaaccatcaacccc

SEQ ID NO: 2010 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIMPDGSMLFRVTINP

SEQ ID NO: 2011 - DNA, 474 bp, Artificial Sequence; identical to SEQ ID NO: 1781
  Synthetic

SEQ ID NO: 2012 - protein, 158 aa, Artificial Sequence; identical to SEQ ID NO: 1782
  Synthetic

SEQ ID NO: 2013 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcccccccgacggctccatgctgttccgagtaaccatcaacccc

SEQ ID NO: 2014 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIPPDGSMLFRVTINP

SEQ ID NO: 2015 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccagcccgacggctccatgctgttccgagtaaccatcaacccc

SEQ ID NO: 2016 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIQPDGSMLFRVTINP

SEQ ID NO: 2017 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatccggcccgacggctccatgctgttccgagtaaccatcaacccc

SEQ ID NO: 2018 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIRPDGSMLFRVTINP

SEQ ID NO: 2019 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcagccccgacggctccatgctgttccgagtaaccatcaacccc

SEQ ID NO: 2020 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLISPDGSMLFRVTINP

SEQ ID NO: 2021 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcgtgcccgacggctccatgctgttccgagtaaccatcaacccc

SEQ ID NO: 2022 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIVPDGSMLFRVTINP

SEQ ID NO: 2023 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctggcccgacggctccatgctgttccgagtaaccatcaacccc

SEQ ID NO: 2024 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIWPDGSMLFRVTINP

SEQ ID NO: 2025 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatctaccccgacggctccatgctgttccgagtaaccatcaacccc

SEQ ID NO: 2026 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLIYPDGSMLFRVTINP

SEQ ID NO: 2027 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgcc

SEQ ID NO: 2028 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINA

SEQ ID NO: 2029 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgc

SEQ ID NO: 2030 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINC

SEQ ID NO: 2031 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgac

SEQ ID NO: 2032 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIND

SEQ ID NO: 2033 - DNA, 474 bp, Artificial Sequence; identical to SEQ ID NO: 1795
  Synthetic

SEQ ID NO: 2034 - protein, 158 aa, Artificial Sequence; identical to SEQ ID NO: 1796
  Synthetic

SEQ ID NO: 2035 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacttc

SEQ ID NO: 2036 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINF

SEQ ID NO: 2037 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacggc

SEQ ID NO: 2038 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTING

SEQ ID NO: 2039 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2040 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2041 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatc

SEQ ID NO: 2042 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINI

SEQ ID NO: 2043 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaag

SEQ ID NO: 2044 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINK

SEQ ID NO: 2045 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacctg

SEQ ID NO: 2046 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINL

SEQ ID NO: 2047 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacatg

SEQ ID NO: 2048 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINM

SEQ ID NO: 2049 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacaac

SEQ ID NO: 2050 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINN

SEQ ID NO: 2051 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccag

SEQ ID NO: 2052 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINQ

SEQ ID NO: 2053 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccgg

SEQ ID NO: 2054 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINR

SEQ ID NO: 2055 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2056 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 2057 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacacc

SEQ ID NO: 2058 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINT

SEQ ID NO: 2059 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacgtg

SEQ ID NO: 2060 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINV

SEQ ID NO: 2061 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactgg

SEQ ID NO: 2062 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINW

SEQ ID NO: 2063 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaactac

SEQ ID NO: 2064 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINY

SEQ ID NO: 2065 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2066 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMLNYFGRPYEGIAVFDGKKITVTGTLWNGNKIIDERLITPDGSMLFRVTINP

SEQ ID NO: 2067 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2068 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEEIFKVVYPVDDHHFKVILHYGTLVIDGVTPNMINYFGRPYEGIAVFDGKKITVTGTLWNGNKIIDERLITPDGSMLFRVTINP

SEQ ID NO: 2069 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcgacccc

SEQ ID NO: 2070 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTIDP

SEQ ID NO: 2071 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2072 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKVFKVVYPVDDHHFKVILHYGTLVIDGVTPNMINYFGRPYEGIAVFDGKKITVTGTLWNGNKIIDERLITPDGSMLFRVTINP

SEQ ID NO: 2073 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcatgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2074 - protein, 158 aa, Artificial Sequence
  Synthetic
VFTLEDFVGDWEQTAAYNLDQVLEQGGVSSLFQNLAVSVTPIQRIVLSDENALKIDIRVIIPYEGLSADQMAQIEKIFKVVYPVDDHHFKVIMHYGTLVVDGVTPNMINYFGRPYEGIAVFDGKKITVTGTLWNGNKIIDERLITPDGSMLFRVTINP

SEQ ID NO: 2075 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtagtggacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2076 - protein, 158 aa, Artificial Sequence
  Synthetic
VFTLEDFVGDWEQTAAYNLDQVLEQGGVSSLLQNLAASVTPIQRIVLSGENALKIDIHVIIPYEGLSADQMAQIEKIFKVVYPVDDHHFKVILHYGTLVVDGVTPNMINYFGRPYEGIAVFDGKKITVTGTLWNGNKIIDERLITPDGSMLFRVTINP

SEQ ID NO: 2077 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2078 - protein, 158 aa, Artificial Sequence
  Synthetic
VFTLEDFVGDWEQTAAYNLDQVLEQGGVSSLLQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2079 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggccatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2080 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKAILHYGTLVIDGVTPNMINYFGRPYEGIAVFDGKKITVTGTLWNGNKIIDERLITPDGSMLFRVTINP

SEQ ID NO: 2081 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaagggtggtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2082 - protein, 158 aa, Artificial Sequence
  Synthetic
VFTLEDFVGDWEQTAAYNLDQVLEQGGVSSLFQNLAVSVTPIQRVVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2083 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacgtgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2084 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDQHFKVILHYGTLVIDGVTPNVINYFGRPYEGIAVFDGKKITVTGTLWNGNKIIDERLITPDGSMLFRVTINP

SEQ ID NO: 2085 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcacctgatcacccccgacggctccatgctgttccgagtaaccatcaacccc

SEQ ID NO: 2086 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDEHLITPDGSMLFRVTINP

SEQ ID NO: 2087 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcaggacctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2088 - protein, 158 aa, Artificial Sequence
  Synthetic
VFTLEDFVGDWEQTAAYNLDQVLEQGGVSSLFQDLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2089 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacaaccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggccacaaaattatcgacgagcgcctgatcacccccgacggctccatgctgttccgagtaaccatcaacccc

SEQ ID NO: 2090 - protein, 158 aa, Artificial Sequence
  Synthetic
VFTLEDFVGDWEQTAAYNLDQVLEQGGVSSLFQNLAVSVTPIQRIVLSGENALKIDNHVIIPYEGLSADQMAQIEKIFKVVYPVDDHHFKVILHYGTLVIDGVTPNMINYFGRPYEGIAVFDGKKITVTGTLWNGHKIIDERLITPDGSMLFRVTINP

SEQ ID NO: 2091 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccagagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2092 - protein, 158 aa, Artificial Sequence
  Synthetic
VFTLEDFVGDWEQTAAYNLDQVLEQGGVSSLFQNLAVSVTPIQRIVQSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2093 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcgtgccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2094 - protein, 158 aa, Artificial Sequence
  Synthetic
VFTLEDFVGDWEQTAAYNLDQVLEQGGVSSLFQNLAVSVTPIQRIVLSGENALKIDIHVIVPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2095 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcaaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2096 - protein, 158 aa, Artificial Sequence
  Synthetic
VFTLEDFVGDWEQTAAYNLDQVLEQGGVSSLFQNLAVSVTPIQRIVLSGENTLKIDIHVIIPYEGLSADQMAQIKKIFKVVYPVDDHHFKVILHYGTLVIDGVTPNMINYFGRLYEGIAVFDGKKITVTGTLWNGNKIIDERLITPDGSMLFRVTINP

SEQ ID NO: 2097 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgcctccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2098 - protein, 158 aa, Artificial Sequence
  Synthetic
VFTLEDFVGDWEQTAAYNLDQVLEQGGVSSLFQNLAASVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2099 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaataccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2100 - protein, 158 aa, Artificial Sequence
  Synthetic
VFTLEDFVGDWEQTAAYNLDQVLEQGGVSSLFQNLAVSVTPIQRIVLSGENTLKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2101 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccgggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2102 - protein, 158 aa, Artificial Sequence
  Synthetic
VFTLEDFVGDWEQTAAYNLDQVLEQGGVSSLFQNLAVSVTPIQRIVLSGENALKIDIRVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2103 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgccatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2104 - protein, 158 aa, Artificial Sequence
  Synthetic
VFTLEDFVGDWEQTAAYNLDQVLEQGGVSSLFQNLAVSVTPIQRIVLSGENALKIDIHAIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2105 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcaagaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2106 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIKKIFKVVYPVDDHHFKVILHYGTLVIDGVTPNMINYFGRPYEGIAVFDGKKITVTGTLWNGNKIIDERLITPDGSMLFRVTINP

SEQ ID NO: 2107 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcagcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2108 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDQHFKVILHYGTLVIDGVTPNMINYFGRPYEGIAVFDGKKITVTGTLWNGNKIIDERLITPDGSMLFRVTINP

SEQ ID NO: 2109 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2110 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2111 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcgagaagatcactgtaacagggaccctgtggaacggcaacaaaattatcgacgagcgcctgatcacccccgacggctccatgctgttccgagtaaccatcaacccc

SEQ ID NO: 2112 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGEKITVTGTLWNGNKIIDERLITPDGSMLFRVTINP

SEQ ID NO: 2113 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaagcgggaccctgtggaacggcaacaaaattatcgacgagcgcctgatcacccccgacggctccatgctgttccgagtaaccatcaacccc

SEQ ID NO: 2114 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVSGTLWNGNKIIDERLITPDGSMLFRVTINP

SEQ ID NO: 2115 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgccagatcacccccgacggctccatgctgttccgagtaaacatcaacccc

SEQ ID NO: 2116 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERQITPDGSMLFRVNINP

SEQ ID NO: 2117 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcgacccc

SEQ ID NO: 2118 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTIDP

SEQ ID NO: 2119 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccaggtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2120 - protein, 158 aa, Artificial Sequence
  Synthetic
VFTLEDFVGDWEQTAAYNLDQVLEQGGVSSLFQNLAVSVTPIQRIVLSGENALKIDIQVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2121 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcatgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2122 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVIMHYGTLVIDGVTPNMINYFGRPYEGIAVFDGKKITVTGTLWNGNKIIDERLITPDGSMLFRVTINP

SEQ ID NO: 2123 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggctgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2124 - protein, 158 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRLYEGIAVFDGKKITVTGTLWNGNKIIDERLITPDGSMLFRVTINP

SEQ ID NO: 2125 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcgacgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2126 - protein, 158 aa, Artificial Sequence
  Synthetic
VFTLEDFVGDWEQTAAYNLDQVLEQGGVSSLFQNLAVSVTPIQRIVLSDENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINP

SEQ ID NO: 2127 - DNA, 441 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtcctgagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgac

SEQ ID NO: 2128 - protein, 147 aa, Artificial Sequence
  Synthetic
VFTLEDFVGDWEQTAAYNLDQVLEQGGVSSLFQNLAVSVTPIQRIVLSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPD

SEQ ID NO: 2129 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2130 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINS

SEQ ID NO: 2131 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccacagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgcactatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaaccac

SEQ ID NO: 2132 - protein, 158 aa, Artificial Sequence
  Synthetic
VFTLEDFVGDWEQTAAYNLDQVLEQGGVSSLFQNLAVSVTPIQRIVHSGENALKIDIHVIIPYEGLSADQMAQIEKIFKVVYPVDDHHFKVILHYGTLVIDGVTPNMINYFGRPYEGIAVFDGKKITVTGTLWNGNKIIDERLITPDGSMLFRVTINH

SEQ ID NO: 2133 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2134 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2135 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2136 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINP

SEQ ID NO: 2137 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2138 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINP

SEQ ID NO: 2139 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacccc

SEQ ID NO: 2140 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINP

SEQ ID NO: 2141 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaaatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2142 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEKIFKVVYPVDDHHFKVILPYGTLVIDGVTPNMINYFGRPYEGIAVFDGKKITVTGTLWNGNKIIDERLITPDGSMLFRVTINS

SEQ ID NO: 2143 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2144 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEEIFKVVYPVDDHHFKVILPYGTLVIDGVTPNMINYFGRPYEGIAVFDGKKITVTGTLWNGNKIIDERLITPDGSMLFRVTINS

SEQ ID NO: 2145 - DNA, 474 bp, Artificial Sequence
  Synthetic
gtcttcacactcgaagatttcgttggggactgggaacagacagccgcctacaacctggaccaagtccttgaacagggaggtgtgtccagtttgtttcagaatctcgccgtgtccgtaactccgatccaaaggattgtccggagcggtgaaaatgccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2146 - protein, 158 aa, Artificial Sequence
  Synthetic
VFTLEDFVGDWEQTAAYNLDQVLEQGGVSSLFQNLAVSVTPIQRIVRSGENALKIDIHVIIPYEGLSADQMAQIEKVFKVVYPVDDHHFKVILPYGTLVIDGVTPNMINYFGRPYEGIAVFDGKKITVTGTLWNGNKIIDERLITPDGSMLFRVTINS

SEQ ID NO: 2147 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2148 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 2149 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaatgccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2150 - protein, 158 aa, Artificial Sequence
  Synthetic
VFTLEDFVGDWEQTAAYNLDQVLEQGGVSSLLQNLAVSVTPIQRIVRSGENALKIDIHVIIPYEGLSADQMAQIEEVFKVVYPVDDHHFKVILPYGTLVIDGVTPNMLNYFGRPYEGIAVFDGKKITVTGTLWNGNKIIDERLITPDGSMLFRVTINS

SEQ ID NO: 2151 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaaaaagtgtttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2152 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEKVFKVVYPVDDHHFKVILPYGTLVIDGVTPNMLNYFGRPYEGIAVFDGKKITVTGTLWNGNKIIDERLITPDGSMLFRVTINS

SEQ ID NO: 2153 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagagatttttaaggtggtgtaccctgtggatgatcatcactttaaggtgatcctgccctatggcacactggtaatcgacggggttacgccgaacatgctgaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2154 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEIFKVVYPVDDHHFKVILPYGTLVIDGVTPNMLNYFGRPYEGIAVFDGKKITVTGTLWNGNKIIDERLITPDGSMLFRVTINS

SEQ ID NO: 2155 - DNA, 474 bp, Artificial Sequence
  Synthetic
gtcttcacactcgaagatttcgttggggactgggaacagacagccgcctacaacctggaccaagtccttgaacagggaggtgtgtccagtttgctgcagaatctcgccgtgtccgtaactccgatccaaaggattgtccggagcggtgaaaataccctgaagatcgacatccatgtcatcatcccgtatgaaggtctgagcgccgaccaaatggcccagatcgaagaggtgtttaaggtggtgtaccctgtggatgatcatcactttaaggtgatcctgccctatggcacactggtaatcgacggggttacgccgaacatgatcaactatttcggacggccgtatgaaggcatcgccgtgttcgacggcaaaaagatcactgtaacagggaccctgtggaacggcaacaaaattatcgacgagcgcctgatcacccccgacggctccatgctgttccgagtaaccatcaacagc

SEQ ID NO: 2156 - protein, 158 aa, Artificial Sequence
  Synthetic
VFTLEDFVGDWEQTAAYNLDQVLEQGGVSSLLQNLAVSVTPIQRIVRSGENTLKIDIHVIIPYEGLSADQMAQIEEVFKVVYPVDDHHFKVILPYGTLVIDGVTPNMINYFGRPYEGIAVFDGKKITVTGTLWNGNKIIDERLITPDGSMLFRVTINS

SEQ ID NO: 2157 - protein, 171 aa, Artificial Sequence
  Synthetic
MVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 2158 - DNA, 939 bp, Artificial Sequence
  Synthetic
ctcgagccaaccactgaggatctgtactttcagagcgataacgatggatccgaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtctactctggagatttccggttaa

SEQ ID NO: 2159 - protein, 312 aa, Artificial Sequence
  Synthetic
LEPTTEDLYFQSDNDGSEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISG

SEQ ID NO: 2160 - DNA, 939 bp, Artificial Sequence
  Synthetic
atggcagaaatcggtactggctttccattcgacccccattatgtggaagtcctgggcgagcgcatgcactacgtcgatgttggtccgcgcgatggcacccctgtgctgttcctgcacggtaacccgacctcctcctacgtgtggcgcaacatcatcccgcatgttgcaccgacccatcgctgcattgctccagacctgatcggtatgggcaaatccgacaaaccagacctgggttatttcttcgacgaccacgtccgcttcatggatgccttcatcgaagccctgggtctggaagaggtcgtcctggtcattcacgactggggctccgctctgggtttccactgggccaagcgcaatccagagcgcgtcaaaggtattgcatttatggagttcatccgccctatcccgacctgggacgaatggccagaatttgcccgcgagaccttccaggccttccgcaccaccgacgtcggccgcaagctgatcatcgatcagaacgtttttatcgagggtacgctgccgatgggtgtcgtccgcccgctgactgaagtcgagatggaccattaccgcgagccgttcctgaatcctgttgaccgcgagccactgtggcgcttcccaaacgagctgccaatcgccggtgagccagcgaacatcgtcgcgctggtcgaagaatacatggactggctgcaccagtcccctgtcccgaagctgctgttctggggcaccccaggcgttctgatcccaccggccgaagccgctcgcctggccaaaagcctgcctaactgcaaggctgtggacatcggcccgggtctgaatctgctgcaagaagacaacccggacctgatcggcagcgagatcgcgcgctggctgtcgacgctcgagatttccggcgagccaaccactgaggatctgtactttcagagcgataacgcgatcgcc

SEQ ID NO: 2161 - protein, 313 aa, Artificial Sequence
  Synthetic
MAEIGTGFPFDPHYVEVLGERMHYVDVGPRDGTPVLFLHGNPTSSYVWRNIIPHVAPTHRCIAPDLIGMGKSDKPDLGYFFDDHVRFMDAFIEALGLEEVVLVIHDWGSALGFHWAKRNPERVKGIAFMEFIRPIPTWDEWPEFARETFQAFRTTDVGRKLIIDQNVFIEGTLPMGVVRPLTEVEMDHYREPFLNPVDREPLWRFPNELPIAGEPANIVALVEEYMDWLHQSPVPKLLFWGTPGVLIPPAEAARLAKSLPNCKAVDIGPGLNLLQEDNPDLIGSEIARWLSTLEISGEPTTEDLYFQSDNAIA

SEQ ID NO: 2162 - DNA, 36 bp, Artificial Sequence
  Synthetic
atggtgaccggctaccggctgttcgaggagatcagc

SEQ ID NO: 2163 - protein, 12 aa, Artificial Sequence
  Synthetic
MVTGYRLFEEIS

SEQ ID NO: 2164 - DNA, 36 bp, Artificial Sequence
  Synthetic
atggtgaccggctaccggctgttcgaggaggccagc

SEQ ID NO: 2165 - protein, 12 aa, Artificial Sequence
  Synthetic
MVTGYRLFEEAS

SEQ ID NO: 2166 - DNA, 36 bp, Artificial Sequence
  Synthetic
atggtgaccggctaccggctgttcgaggaggagagc

SEQ ID NO: 2167 - protein, 12 aa, Artificial Sequence
  Synthetic
MVTGYRLFEEES

SEQ ID NO: 2168 - DNA, 36 bp, Artificial Sequence
  Synthetic
atggtgaccggctaccggctgttcgaggagatcctg

SEQ ID NO: 2169 - protein, 12 aa, Artificial Sequence
  Synthetic
MVTGYRLFEEIL

SEQ ID NO: 2170 - DNA, 36 bp, Artificial Sequence
  Synthetic
atggtgaccggctaccggctgttcgaggaggccctg

SEQ ID NO: 2171 - protein, 12 aa, Artificial Sequence
  Synthetic
MVTGYRLFEEAL

SEQ ID NO: 2172 - DNA, 36 bp, Artificial Sequence
  Synthetic
atggtgaccggctaccggctgttcgaggaggagctg

SEQ ID NO: 2173 - protein, 12 aa, Artificial Sequence
  Synthetic
MVTGYRLFEEEL

SEQ ID NO: 2174 - DNA, 36 bp, Artificial Sequence
  Synthetic
atggtggagggctaccggctgttcgaggagatcagc

SEQ ID NO: 2175 - protein, 12 aa, Artificial Sequence
  Synthetic
MVEGYRLFEEIS

SEQ ID NO: 2176 - DNA, 36 bp, Artificial Sequence
  Synthetic
atggtggagggctaccggctgttcgaggaggccagc

SEQ ID NO: 2177 - protein, 12 aa, Artificial Sequence
  Synthetic
MVEGYRLFEEAS

SEQ ID NO: 2178 - DNA, 36 bp, Artificial Sequence
  Synthetic
atggtggagggctaccggctgttcgaggaggagagc

SEQ ID NO: 2179 - protein, 12 aa, Artificial Sequence
  Synthetic
MVEGYRLFEEES

SEQ ID NO: 2180 - DNA, 36 bp, Artificial Sequence
  Synthetic
atggtggagggctaccggctgttcgaggagatcctg

SEQ ID NO: 2181 - protein, 12 aa, Artificial Sequence
  Synthetic
MVEGYRLFEEIL

SEQ ID NO: 2182 - DNA, 36 bp, Artificial Sequence
  Synthetic
atggtggagggctaccggctgttcgaggaggccctg

SEQ ID NO: 2183 - protein, 12 aa, Artificial Sequence
  Synthetic
MVEGYRLFEEAL

SEQ ID NO: 2184 - DNA, 36 bp, Artificial Sequence
  Synthetic
atggtggagggctaccggctgttcgaggaggagctg

SEQ ID NO: 2185 - protein, 12 aa, Artificial Sequence
  Synthetic
MVEGYRLFEEEL

SEQ ID NO: 2186 - DNA, 36 bp, Artificial Sequence
  Synthetic
atggtgaccggctaccggctgttcaagaagatcctg

SEQ ID NO: 2187 - protein, 12 aa, Artificial Sequence
  Synthetic
MVTGYRLFKKIL

SEQ ID NO: 2188 - DNA, 36 bp, Artificial Sequence
  Synthetic
atggtgaccggctaccggctgatgaagaagatcctg

SEQ ID NO: 2189 - protein, 12 aa, Artificial Sequence
  Synthetic
MVTGYRLMKKIL

SEQ ID NO: 2190 - DNA, 36 bp, Artificial Sequence
  Synthetic
atggtgaccggctaccggctgcacaagaagatcctg

SEQ ID NO: 2191 - protein, 12 aa, Artificial Sequence
  Synthetic
MVTGYRLHKKIL

SEQ ID NO: 2192 - DNA, 36 bp, Artificial Sequence
  Synthetic
atggtgaccggctaccggctgctgaagaagatcctg

SEQ ID NO: 2193 - protein, 12 aa, Artificial Sequence
  Synthetic
MVTGYRLLKKIL

SEQ ID NO: 2194 - DNA, 36 bp, Artificial Sequence
  Synthetic
atggtgaccggctaccggctgagcaagaagatcctg

SEQ ID NO: 2195 - protein, 12 aa, Artificial Sequence
  Synthetic
MVTGYRLSKKIL

SEQ ID NO: 2196 - DNA, 36 bp, Artificial Sequence
  Synthetic
atggtgaccggctaccggctgttcgagaagatcctg

SEQ ID NO: 2197 - protein, 12 aa, Artificial Sequence
  Synthetic
MVTGYRLFEKIL

SEQ ID NO: 2198 - DNA, 36 bp, Artificial Sequence
  Synthetic
atggtgaccggctaccggctgatggagaagatcctg

SEQ ID NO: 2199 - protein, 12 aa, Artificial Sequence
  Synthetic
MVTGYRLMEKIL

SEQ ID NO: 2200 - DNA, 36 bp, Artificial Sequence
  Synthetic
atggtgaccggctaccggctgcacgagaagatcctg

SEQ ID NO: 2201 - protein, 12 aa, Artificial Sequence
  Synthetic
MVTGYRLHEKIL

SEQ ID NO: 2202 - DNA, 36 bp, Artificial Sequence
  Synthetic
atggtgaccggctaccggctgctggagaagatcctg

SEQ ID NO: 2203 - protein, 12 aa, Artificial Sequence
  Synthetic
MVTGYRLLEKIL

SEQ ID NO: 2204 - DNA, 36 bp, Artificial Sequence
  Synthetic
atggtgaccggctaccggctgagcgagaagatcctg

SEQ ID NO: 2205 - protein, 12 aa, Artificial Sequence
  Synthetic
MVTGYRLSEKIL

SEQ ID NO: 2206 - DNA, 36 bp, Artificial Sequence
  Synthetic
atggtgaccggctaccggctgatggaggagatcctg

SEQ ID NO: 2207 - protein, 12 aa, Artificial Sequence
  Synthetic
MVTGYRLMEEIL

SEQ ID NO: 2208 - DNA, 36 bp, Artificial Sequence
  Synthetic
atggtgaccggctaccggctgcacgaggagatcctg

SEQ ID NO: 2209 - protein, 12 aa, Artificial Sequence
  Synthetic
MVTGYRLHEEIL

SEQ ID NO: 2210 - DNA, 36 bp, Artificial Sequence
  Synthetic
atggtgaccggctaccggctgctggaggagatcctg

SEQ ID NO: 2211 - protein, 12 aa, Artificial Sequence
  Synthetic
MVTGYRLLEEIL

SEQ ID NO: 2212 - DNA, 36 bp, Artificial Sequence
  Synthetic
atggtgaccggctaccggctgagcgaggagatcctg

SEQ ID NO: 2213 - protein, 12 aa, Artificial Sequence
  Synthetic
MVTGYRLSEEIL

SEQ ID NO: 2214 - DNA, 36 bp, Artificial Sequence
  Synthetic
atggtgagcggctaccggctgttcgaggagatcctg

SEQ ID NO: 2215 - protein, 12 aa, Artificial Sequence
  Synthetic
MVSGYRLFEEIL

SEQ ID NO: 2216 - DNA, 36 bp, Artificial Sequence
  Synthetic
atggtgaccggctggcggctgttcgaggagatcctg

SEQ ID NO: 2217 - protein, 12 aa, Artificial Sequence
  Synthetic
MVTGWRLFEEIL

SEQ ID NO: 2218 - DNA, 36 bp, Artificial Sequence
  Synthetic
atggtgagcggctggcggctgttcgaggagatcctg

SEQ ID NO: 2219 - protein, 12 aa, Artificial Sequence
  Synthetic
MVSGWRLFEEIL

SEQ ID NO: 2220 - DNA, 39 bp, Artificial Sequence
  Synthetic
atgaacgtgaccggctaccggctgttcgaggagatcctg

SEQ ID NO: 2221 - protein, 13 aa, Artificial Sequence
  Synthetic
MNVTGYRLFEEIL

SEQ ID NO: 2222 - DNA, 39 bp, Artificial Sequence
  Synthetic
atggtgaccggctaccggctgttcgaggagatcctgaac

SEQ ID NO: 2223 - protein, 13 aa, Artificial Sequence
  Synthetic
MVTGYRLFEEILN

SEQ ID NO: 2224 - DNA, 42 bp, Artificial Sequence
  Synthetic
atgaacgtgaccggctaccggctgttcgaggagatcctgaac

SEQ ID NO: 2225 - protein, 14 aa, Artificial Sequence
  Synthetic
MNVTGYRLFEEILN

SEQ ID NO: 2226 - DNA, 33 bp, Artificial Sequence
  Synthetic
atggtgaccggctaccggctgttcgaggagatc

SEQ ID NO: 2227 - protein, 11 aa, Artificial Sequence
  Synthetic
MVTGYRLFEEI

SEQ ID NO: 2228 - DNA, 36 bp, Artificial Sequence
  Synthetic
atggtgaccggctaccggctgttccagaagatcagc

SEQ ID NO: 2229 - protein, 12 aa, Artificial Sequence
  Synthetic
MVTGYRLFQKIS

SEQ ID NO: 2230 - DNA, 39 bp, Artificial Sequence
  Synthetic
atggtgaccggctaccggctgttcaagaagatcagcaac

SEQ ID NO: 2231 - protein, 13 aa, Artificial Sequence
  Synthetic
MVTGYRLFKKISN

SEQ ID NO: 2232 - DNA, 36 bp, Artificial Sequence
  Synthetic
atggtgaccggctaccggctgttcaagaagatcagc

SEQ ID NO: 2233 - protein, 12 aa, Artificial Sequence
  Synthetic
MVTGYRLFKKIS

SEQ ID NO: 2234 - protein, 13 aa, Artificial Sequence
  Synthetic
MVSGWRLFKKISA

SEQ ID NO: 2235 - protein, 13 aa, Artificial Sequence
  Synthetic
MGVSGWRLFKKIS

SEQ ID NO: 2236 - protein, 14 aa, Artificial Sequence
  Synthetic
MSVSGWRLFKKISN

SEQ ID NO: 2237 - protein, 14 aa, Artificial Sequence
  Synthetic
MSVSGWRLFKKISA

SEQ ID NO: 2238 - protein, 15 aa, Artificial Sequence
  Synthetic
MNSVSGWRLFKKISA

SEQ ID NO: 2239 - protein, 15 aa, Artificial Sequence
  Synthetic
MNSVSGWRLFKKISN

SEQ ID NO: 2240 - protein, 14 aa, Artificial Sequence
  Synthetic
MSNVSGWRLFKKIS

SEQ ID NO: 2241 - protein, 14 aa, Artificial Sequence
  Synthetic
MSGVSGWRLFKKIS

SEQ ID NO: 2242 - protein, 15 aa, Artificial Sequence
  Synthetic
MNSNVSGWRLFKKIS

SEQ ID NO: 2243 - protein, 15 aa, Artificial Sequence
  Synthetic
MNSGVSGWRLFKKIS

SEQ ID NO: 2244 - protein, 13 aa, Artificial Sequence
  Synthetic
MSVSGWRLFKKIS

SEQ ID NO: 2245 - protein, 14 aa, Artificial Sequence
  Synthetic
MNSVSGWRLFKKIS

SEQ ID NO: 2246 - protein, 15 aa, Artificial Sequence
  Synthetic
MSNVSGWRLFKKISN

SEQ ID NO: 2247 - protein, 16 aa, Artificial Sequence
  Synthetic
MNSNVSGWRLFKKISN

SEQ ID NO: 2248 - protein, 8 aa, Artificial Sequence
  Synthetic
MGWRLFKK

SEQ ID NO: 2249 - protein, 8 aa, Artificial Sequence
  Synthetic
MGWALFKK

SEQ ID NO: 2250 - protein, 12 aa, Artificial Sequence
  Synthetic
MVTGWALFEEIL

SEQ ID NO: 2251 - protein, 12 aa, Artificial Sequence
  Synthetic
MVTGYALFQEIL

SEQ ID NO: 2252 - protein, 12 aa, Artificial Sequence
  Synthetic
MVTGYALFEQIL

SEQ ID NO: 2253 - protein, 12 aa, Artificial Sequence
  Synthetic
MVTGYALFEEIL

SEQ ID NO: 2254 - DNA, 36 bp, Artificial Sequence
  Synthetic
atggtgtccggctgggcactgttcaagaaaatttcc

SEQ ID NO: 2255 - protein, 12 aa, Artificial Sequence
  Synthetic
MVSGWALFKKIS

SEQ ID NO: 2256 - protein, 12 aa, Artificial Sequence
  Synthetic
MVSGWKLFKKIS

SEQ ID NO: 2257 - DNA, 36 bp, Artificial Sequence
  Synthetic
atggtgtccggctggcagctgttcaagaaaatttcc

SEQ ID NO: 2258 - protein, 12 aa, Artificial Sequence
  Synthetic
MVSGWQLFKKIS

SEQ ID NO: 2259 - protein, 12 aa, Artificial Sequence
  Synthetic
MVSGWELFKKIS

SEQ ID NO: 2260 - DNA, 36 bp, Artificial Sequence
  Synthetic
atggtgtccggctggctgctgttcaagaaaatttcc

SEQ ID NO: 2261 - protein, 12 aa, Artificial Sequence
  Synthetic
MVSGWLLFKKIS

SEQ ID NO: 2262 - DNA, 36 bp, Artificial Sequence
  Synthetic
atggtgtccggctgggtgctgttcaagaaaatttcc

SEQ ID NO: 2263 - protein, 12 aa, Artificial Sequence
  Synthetic
MVSGWVLFKKIS

SEQ ID NO: 2264 - DNA, 33 bp, Artificial Sequence
  Synthetic
gtgaccggctaccggctgttcgaggagatcagc

SEQ ID NO: 2265 - protein, 11 aa, Artificial Sequence
  Synthetic
VTGYRLFEEIS

SEQ ID NO: 2266 - DNA, 33 bp, Artificial Sequence
  Synthetic
gtgaccggctaccggctgttcgaggaggccagc

SEQ ID NO: 2267 - protein, 11 aa, Artificial Sequence
  Synthetic
VTGYRLFEEAS

SEQ ID NO: 2268 - DNA, 33 bp, Artificial Sequence
  Synthetic
gtgaccggctaccggctgttcgaggaggagagc

SEQ ID NO: 2269 - protein, 11 aa, Artificial Sequence
  Synthetic
VTGYRLFEEES

SEQ ID NO: 2270 - DNA, 33 bp, Artificial Sequence
  Synthetic
gtgaccggctaccggctgttcgaggagatcctg

SEQ ID NO: 2271 - protein, 11 aa, Artificial Sequence
  Synthetic
VTGYRLFEEIL

SEQ ID NO: 2272 - DNA, 33 bp, Artificial Sequence
  Synthetic
gtgaccggctaccggctgttcgaggaggccctg

SEQ ID NO: 2273 - protein, 11 aa, Artificial Sequence
  Synthetic
VTGYRLFEEAL

SEQ ID NO: 2274 - DNA, 33 bp, Artificial Sequence
  Synthetic
gtgaccggctaccggctgttcgaggaggagctg

SEQ ID NO: 2275 - protein, 11 aa, Artificial Sequence
  Synthetic
VTGYRLFEEEL

SEQ ID NO: 2276 - DNA, 33 bp, Artificial Sequence
  Synthetic
gtggagggctaccggctgttcgaggagatcagc

SEQ ID NO: 2277 - protein, 11 aa, Artificial Sequence
  Synthetic
VEGYRLFEEIS

SEQ ID NO: 2278 - DNA, 33 bp, Artificial Sequence
  Synthetic
gtggagggctaccggctgttcgaggaggccagc

SEQ ID NO: 2279 - protein, 11 aa, Artificial Sequence
  Synthetic
VEGYRLFEEAS

SEQ ID NO: 2280 - DNA, 33 bp, Artificial Sequence
  Synthetic
gtggagggctaccggctgttcgaggaggagagc

SEQ ID NO: 2281 - protein, 11 aa, Artificial Sequence
  Synthetic
VEGYRLFEEES

SEQ ID NO: 2282 - DNA, 33 bp, Artificial Sequence
  Synthetic
gtggagggctaccggctgttcgaggagatcctg

SEQ ID NO: 2283 - protein, 11 aa, Artificial Sequence
  Synthetic
VEGYRLFEEIL

SEQ ID NO: 2284 - DNA, 33 bp, Artificial Sequence
  Synthetic
gtggagggctaccggctgttcgaggaggccctg

SEQ ID NO: 2285 - protein, 11 aa, Artificial Sequence
  Synthetic
VEGYRLFEEAL

SEQ ID NO: 2286 - DNA, 33 bp, Artificial Sequence
  Synthetic
gtggagggctaccggctgttcgaggaggagctg

SEQ ID NO: 2287 - protein, 11 aa, Artificial Sequence
  Synthetic
VEGYRLFEEEL

SEQ ID NO: 2288 - DNA, 33 bp, Artificial Sequence
  Synthetic
gtgaccggctaccggctgttcaagaagatcctg

SEQ ID NO: 2289 - protein, 11 aa, Artificial Sequence
  Synthetic
VTGYRLFKKIL

SEQ ID NO: 2290 - DNA, 33 bp, Artificial Sequence
  Synthetic
gtgaccggctaccggctgatgaagaagatcctg

SEQ ID NO: 2291 - protein, 11 aa, Artificial Sequence
  Synthetic
VTGYRLMKKIL

SEQ ID NO: 2292 - DNA, 33 bp, Artificial Sequence
  Synthetic
gtgaccggctaccggctgcacaagaagatcctg

SEQ ID NO: 2293 - protein, 11 aa, Artificial Sequence
  Synthetic
VTGYRLHKKIL

SEQ ID NO: 2294 - DNA, 33 bp, Artificial Sequence
  Synthetic
gtgaccggctaccggctgctgaagaagatcctg

SEQ ID NO: 2295 - protein, 11 aa, Artificial Sequence
  Synthetic
VTGYRLLKKIL

SEQ ID NO: 2296 - DNA, 33 bp, Artificial Sequence
  Synthetic
gtgaccggctaccggctgagcaagaagatcctg

SEQ ID NO: 2297 - protein, 11 aa, Artificial Sequence
  Synthetic
VTGYRLSKKIL

SEQ ID NO: 2298 - DNA, 33 bp, Artificial Sequence
  Synthetic
gtgaccggctaccggctgttcgagaagatcctg

SEQ ID NO: 2299 - protein, 11 aa, Artificial Sequence
  Synthetic
VTGYRLFEKIL

SEQ ID NO: 2300 - DNA, 33 bp, Artificial Sequence
  Synthetic
gtgaccggctaccggctgatggagaagatcctg

SEQ ID NO: 2301 - protein, 11 aa, Artificial Sequence
  Synthetic
VTGYRLMEKIL

SEQ ID NO: 2302 - DNA, 33 bp, Artificial Sequence
  Synthetic
gtgaccggctaccggctgcacgagaagatcctg

SEQ ID NO: 2303 - protein, 11 aa, Artificial Sequence
  Synthetic
VTGYRLHEKIL

SEQ ID NO: 2304 - DNA, 33 bp, Artificial Sequence
  Synthetic
gtgaccggctaccggctgctggagaagatcctg

SEQ ID NO: 2305 - protein, 11 aa, Artificial Sequence
  Synthetic
VTGYRLLEKIL

SEQ ID NO: 2306 - DNA, 33 bp, Artificial Sequence
  Synthetic
gtgaccggctaccggctgagcgagaagatcctg

SEQ ID NO: 2307 - protein, 11 aa, Artificial Sequence
  Synthetic
VTGYRLSEKIL

SEQ ID NO: 2308 - DNA, 33 bp, Artificial Sequence
  Synthetic
gtgaccggctaccggctgatggaggagatcctg

SEQ ID NO: 2309 - protein, 11 aa, Artificial Sequence
  Synthetic
VTGYRLMEEIL

SEQ ID NO: 2310 - DNA, 33 bp, Artificial Sequence
  Synthetic
gtgaccggctaccggctgcacgaggagatcctg

SEQ ID NO: 2311 - protein, 11 aa, Artificial Sequence
  Synthetic
VTGYRLHEEIL

SEQ ID NO: 2312 - DNA, 33 bp, Artificial Sequence
  Synthetic
gtgaccggctaccggctgctggaggagatcctg

SEQ ID NO: 2313 - protein, 11 aa, Artificial Sequence
  Synthetic
VTGYRLLEEIL

SEQ ID NO: 2314 - DNA, 33 bp, Artificial Sequence
  Synthetic
gtgaccggctaccggctgagcgaggagatcctg

SEQ ID NO: 2315 - protein, 11 aa, Artificial Sequence
  Synthetic
VTGYRLSEEIL

SEQ ID NO: 2316 - DNA, 33 bp, Artificial Sequence
  Synthetic
gtgagcggctaccggctgttcgaggagatcctg

SEQ ID NO: 2317 - protein, 11 aa, Artificial Sequence
  Synthetic
VSGYRLFEEIL

SEQ ID NO: 2318 - DNA, 33 bp, Artificial Sequence
  Synthetic
gtgaccggctggcggctgttcgaggagatcctg

SEQ ID NO: 2319 - protein, 11 aa, Artificial Sequence
  Synthetic
VTGWRLFEEIL

SEQ ID NO: 2320 - DNA, 33 bp, Artificial Sequence
  Synthetic
gtgagcggctggcggctgttcgaggagatcctg

SEQ ID NO: 2321 - protein, 11 aa, Artificial Sequence
  Synthetic
VSGWRLFEEIL

SEQ ID NO: 2322 - DNA, 36 bp, Artificial Sequence
  Synthetic
aacgtgaccggctaccggctgttcgaggagatcctg

SEQ ID NO: 2323 - protein, 12 aa, Artificial Sequence
  Synthetic
NVTGYRLFEEIL

SEQ ID NO: 2324 - DNA, 36 bp, Artificial Sequence
  Synthetic
gtgaccggctaccggctgttcgaggagatcctgaac

SEQ ID NO: 2325 - protein, 12 aa, Artificial Sequence
  Synthetic
VTGYRLFEEILN

SEQ ID NO: 2326 - DNA, 39 bp, Artificial Sequence
  Synthetic
aacgtgaccggctaccggctgttcgaggagatcctgaac

SEQ ID NO: 2327 - protein, 13 aa, Artificial Sequence
  Synthetic
NVTGYRLFEEILN

SEQ ID NO: 2328 - DNA, 30 bp, Artificial Sequence
  Synthetic
gtgaccggctaccggctgttcgaggagatc

SEQ ID NO: 2329 - protein, 10 aa, Artificial Sequence
  Synthetic
VTGYRLFEEI

SEQ ID NO: 2330 - DNA, 33 bp, Artificial Sequence
  Synthetic
gtgaccggctaccggctgttccagaagatcagc

SEQ ID NO: 2331 - protein, 11 aa, Artificial Sequence
  Synthetic
VTGYRLFQKIS

SEQ ID NO: 2332 - DNA, 36 bp, Artificial Sequence
  Synthetic
gtgaccggctaccggctgttcaagaagatcagcaac

SEQ ID NO: 2333 - protein, 12 aa, Artificial Sequence
  Synthetic
VTGYRLFKKISN

SEQ ID NO: 2334 - DNA, 33 bp, Artificial Sequence
  Synthetic
gtgaccggctaccggctgttcaagaagatcagc

SEQ ID NO: 2335 - protein, 11 aa, Artificial Sequence
  Synthetic
VTGYRLFKKIS

SEQ ID NO: 2336 - protein, 12 aa, Artificial Sequence
  Synthetic
VSGWRLFKKISA

SEQ ID NO: 2337 - protein, 12 aa, Artificial Sequence
  Synthetic
GVSGWRLFKKIS

SEQ ID NO: 2338 - protein, 13 aa, Artificial Sequence
  Synthetic
SVSGWRLFKKISN

SEQ ID NO: 2339 - protein, 13 aa, Artificial Sequence
  Synthetic
SVSGWRLFKKISA

SEQ ID NO: 2340 - protein, 14 aa, Artificial Sequence
  Synthetic
NSVSGWRLFKKISA

SEQ ID NO: 2341 - protein, 14 aa, Artificial Sequence
  Synthetic
NSVSGWRLFKKISN

SEQ ID NO: 2342 - protein, 13 aa, Artificial Sequence
  Synthetic
SNVSGWRLFKKIS

SEQ ID NO: 2343 - protein, 13 aa, Artificial Sequence
  Synthetic
SGVSGWRLFKKIS

SEQ ID NO: 2344 - protein, 14 aa, Artificial Sequence
  Synthetic
NSNVSGWRLFKKIS

SEQ ID NO: 2345 - protein, 14 aa, Artificial Sequence
  Synthetic
NSGVSGWRLFKKIS

SEQ ID NO: 2346 - protein, 12 aa, Artificial Sequence
  Synthetic
SVSGWRLFKKIS

SEQ ID NO: 2347 - protein, 13 aa, Artificial Sequence
  Synthetic
NSVSGWRLFKKIS

SEQ ID NO: 2348 - protein, 14 aa, Artificial Sequence
  Synthetic
SNVSGWRLFKKISN

SEQ ID NO: 2349 - protein, 15 aa, Artificial Sequence
  Synthetic
NSNVSGWRLFKKISN

SEQ ID NO: 2350 - protein, 7 aa, Artificial Sequence
  Synthetic
GWRLFKK

SEQ ID NO: 2351 - protein, 7 aa, Artificial Sequence
  Synthetic
GWALFKK

SEQ ID NO: 2352 - protein, 11 aa, Artificial Sequence
  Synthetic
VTGWALFEEIL

SEQ ID NO: 2353 - protein, 11 aa, Artificial Sequence
  Synthetic
VTGYALFQEIL

SEQ ID NO: 2354 - protein, 11 aa, Artificial Sequence
  Synthetic
VTGYALFEQIL

SEQ ID NO: 2355 - protein, 11 aa, Artificial Sequence
  Synthetic
VTGYALFEEIL

SEQ ID NO: 2356 - DNA, 33 bp, Artificial Sequence
  Synthetic
gtgtccggctgggcactgttcaagaaaatttcc

SEQ ID NO: 2357 - protein, 11 aa, Artificial Sequence
  Synthetic
VSGWALFKKIS

SEQ ID NO: 2358 - protein, 11 aa, Artificial Sequence
  Synthetic
VSGWKLFKKIS

SEQ ID NO: 2359 - DNA, 33 bp, Artificial Sequence
  Synthetic
gtgtccggctggcagctgttcaagaaaatttcc

SEQ ID NO: 2360 - protein, 11 aa, Artificial Sequence
  Synthetic
VSGWQLFKKIS

SEQ ID NO: 2361 - protein, 11 aa, Artificial Sequence
  Synthetic
VSGWELFKKIS

SEQ ID NO: 2362 - DNA, 33 bp, Artificial Sequence
  Synthetic
gtgtccggctggctgctgttcaagaaaatttcc

SEQ ID NO: 2363 - protein, 11 aa, Artificial Sequence
  Synthetic
VSGWLLFKKIS

SEQ ID NO: 2364 - DNA, 33 bp, Artificial Sequence
  Synthetic
gtgtccggctgggtgctgttcaagaaaatttcc

SEQ ID NO: 2365 - protein, 11 aa, Artificial Sequence
  Synthetic
VSGWVLFKKIS

SEQ ID NO: 2366 - protein, 11 aa, Artificial Sequence
  Synthetic
VTGWRLCERIL

SEQ ID NO: 2367 - protein, 11 aa, Artificial Sequence
  Synthetic
VSGWRLFKKIS

SEQ ID NO: 2368 - protein, 11 aa, Artificial Sequence
  Synthetic
VTGYRLFKKIS

SEQ ID NO: 2369 - protein, 11 aa, Artificial Sequence
  Synthetic
ISGWRLFKKIS

SEQ ID NO: 2370 - protein, 11 aa, Artificial Sequence
  Synthetic
ASGWRLFKKIS

SEQ ID NO: 2371 - protein, 11 aa, Artificial Sequence
  Synthetic
GSGWRLFKKIS

SEQ ID NO: 2372 - protein, 11 aa, Artificial Sequence
  Synthetic
KSGWRLFKKIS

SEQ ID NO: 2373 - protein, 11 aa, Artificial Sequence
  Synthetic
LSGWRLFKKIS

SEQ ID NO: 2374 - protein, 11 aa, Artificial Sequence
  Synthetic
QSGWRLFKKIS

SEQ ID NO: 2375 - protein, 11 aa, Artificial Sequence
  Synthetic
SSGWRLFKKIS

SEQ ID NO: 2376 - protein, 11 aa, Artificial Sequence
  Synthetic
TSGWRLFKKIS

SEQ ID NO: 2377 - protein, 11 aa, Artificial Sequence
  Synthetic
VVGWRLFKKIS

SEQ ID NO: 2378 - protein, 11 aa, Artificial Sequence
  Synthetic
VKGWRLFKKIS

SEQ ID NO: 2379 - protein, 11 aa, Artificial Sequence
  Synthetic
VIGWRLFKKIS

SEQ ID NO: 2380 - protein, 11 aa, Artificial Sequence
  Synthetic
VEGWRLFKKIS

SEQ ID NO: 2381 - protein, 11 aa, Artificial Sequence
  Synthetic
VAGWRLFKKIS

SEQ ID NO: 2382 - protein, 11 aa, Artificial Sequence
  Synthetic
VQGWRLFKKIS

SEQ ID NO: 2383 - protein, 11 aa, Artificial Sequence
  Synthetic
VHGWRLFKKIS

SEQ ID NO: 2384 - protein, 11 aa, Artificial Sequence
  Synthetic
VSAWRLFKKIS

SEQ ID NO: 2385 - protein, 11 aa, Artificial Sequence
  Synthetic
VSSWRLFKKIS

SEQ ID NO: 2386 - protein, 11 aa, Artificial Sequence
  Synthetic
VSGFRLFKKIS

SEQ ID NO: 2387 - protein, 11 aa, Artificial Sequence
  Synthetic
VSGWKLFKKIS

SEQ ID NO: 2388 - protein, 11 aa, Artificial Sequence
  Synthetic
VSGWQLFKKIS

SEQ ID NO: 2389 - protein, 11 aa, Artificial Sequence
  Synthetic
VSGWELFKKIS

SEQ ID NO: 2390 - protein, 11 aa, Artificial Sequence
  Synthetic
VSGWALFKKIS

SEQ ID NO: 2391 - protein, 11 aa, Artificial Sequence
  Synthetic
VSGWRIFKKIS

SEQ ID NO: 2392 - protein, 11 aa, Artificial Sequence
  Synthetic
VSGWRVFKKIS

SEQ ID NO: 2393 - protein, 11 aa, Artificial Sequence
  Synthetic
VSGWRTFKKIS

SEQ ID NO: 2394 - protein, 11 aa, Artificial Sequence
  Synthetic
VSGWRYFKKIS

SEQ ID NO: 2395 - protein, 11 aa, Artificial Sequence
  Synthetic
VSGWRKFKKIS

SEQ ID NO: 2396 - protein, 11 aa, Artificial Sequence
  Synthetic
VSGWRFFKKIS

SEQ ID NO: 2397 - protein, 11 aa, Artificial Sequence
  Synthetic
VSGWRLAKKIS

SEQ ID NO: 2398 - protein, 11 aa, Artificial Sequence
  Synthetic
VSGWRLDKKIS

SEQ ID NO: 2399 - protein, 11 aa, Artificial Sequence
  Synthetic
VSGWRLEKKIS

SEQ ID NO: 2400 - protein, 11 aa, Artificial Sequence
  Synthetic
VSGWRLGKKIS

SEQ ID NO: 2401 - protein, 11 aa, Artificial Sequence
  Synthetic
VSGWRLHKKIS

SEQ ID NO: 2402 - protein, 11 aa, Artificial Sequence
  Synthetic
VSGWRLIKKIS

SEQ ID NO: 2403 - protein, 11 aa, Artificial Sequence
  Synthetic
VSGWRLKKKIS

SEQ ID NO: 2404 - protein, 11 aa, Artificial Sequence
  Synthetic
VSGWRLLKKIS

SEQ ID NO: 2405 - protein, 11 aa, Artificial Sequence
  Synthetic
VSGWRLMKKIS

SEQ ID NO: 2406 - protein, 11 aa, Artificial Sequence
  Synthetic
VSGWRLNKKIS

SEQ ID NO: 2407 - protein, 11 aa, Artificial Sequence
  Synthetic
VSGWRLQKKIS

SEQ ID NO: 2408 - protein, 11 aa, Artificial Sequence
  Synthetic
VSGWRLRKKIS

SEQ ID NO: 2409 - protein, 11 aa, Artificial Sequence
  Synthetic
VSGWRLSKKIS

SEQ ID NO: 2410 - protein, 11 aa, Artificial Sequence
  Synthetic
VSGWRLTKKIS

SEQ ID NO: 2411 - protein, 11 aa, Artificial Sequence
  Synthetic
VSGWRLVKKIS

SEQ ID NO: 2412 - protein, 11 aa, Artificial Sequence
  Synthetic
VSGWRLWKKIS

SEQ ID NO: 2413 - protein, 11 aa, Artificial Sequence
  Synthetic
VSGWRLYKKIS

SEQ ID NO: 2414 - protein, 11 aa, Artificial Sequence
  Synthetic
VSGWRLFEKIS

SEQ ID NO: 2415 - protein, 11 aa, Artificial Sequence
  Synthetic
VSGWRLFVKIS

SEQ ID NO: 2416 - protein, 11 aa, Artificial Sequence
  Synthetic
VSGWRLFSKIS

SEQ ID NO: 2417 - protein, 11 aa, Artificial Sequence
  Synthetic
VSGWRLFRKIS

SEQ ID NO: 2418 - protein, 11 aa, Artificial Sequence
  Synthetic
VSGWRLFTKIS

SEQ ID NO: 2419 - protein, 11 aa, Artificial Sequence
  Synthetic
VSGWRLFNKIS

SEQ ID NO: 2420 - protein, 11 aa, Artificial Sequence
  Synthetic
VSGWRLFQKIS

SEQ ID NO: 2421 - protein, 11 aa, Artificial Sequence
  Synthetic
VSGWRLFKRIS

SEQ ID NO: 2422 - protein, 11 aa, Artificial Sequence
  Synthetic
VSGWRLFKQIS

SEQ ID NO: 2423 - protein, 11 aa, Artificial Sequence
  Synthetic
VSGWRLFKEIS

SEQ ID NO: 2424 - protein, 11 aa, Artificial Sequence
  Synthetic
VSGWRLFKAIS

SEQ ID NO: 2425 - protein, 11 aa, Artificial Sequence
  Synthetic
VSGWRLFKKVS

SEQ ID NO: 2426 - protein, 11 aa, Artificial Sequence
  Synthetic
VSGWRLFKKLS

SEQ ID NO: 2427 - protein, 11 aa, Artificial Sequence
  Synthetic
VSGWRLFKKAS

SEQ ID NO: 2428 - protein, 11 aa, Artificial Sequence
  Synthetic
VSGWRLFKKFS

SEQ ID NO: 2429 - protein, 11 aa, Artificial Sequence
  Synthetic
VSGWRLFKKES

SEQ ID NO: 2430 - protein, 11 aa, Artificial Sequence
  Synthetic
VSGWRLFKKTS

SEQ ID NO: 2431 - protein, 11 aa, Artificial Sequence
  Synthetic
VSGWRLFKKIL

SEQ ID NO: 2432 - protein, 11 aa, Artificial Sequence
  Synthetic
VSGWRLFKKIA

SEQ ID NO: 2433 - protein, 11 aa, Artificial Sequence
  Synthetic
VSGWRLFKKIE

SEQ ID NO: 2434 - protein, 11 aa, Artificial Sequence
  Synthetic
VSGWRLFKKIV

SEQ ID NO: 2435 - protein, 11 aa, Artificial Sequence
  Synthetic
VSGWRLFKKIG

SEQ ID NO: 2436 - protein, 11 aa, Artificial Sequence
  Synthetic
VSGWRLFKKIH

SEQ ID NO: 2437 - protein, 11 aa, Artificial Sequence
  Synthetic
VSGWRLFKKIT

SEQ ID NO: 2438 - protein, 11 aa, Artificial Sequence
  Synthetic
VVGYRLFKKIS

SEQ ID NO: 2439 - protein, 11 aa, Artificial Sequence
  Synthetic
VKGYRLFKKIS

SEQ ID NO: 2440 - protein, 11 aa, Artificial Sequence
  Synthetic
VIGYRLFKKIS

SEQ ID NO: 2441 - protein, 11 aa, Artificial Sequence
  Synthetic
VEGYRLFKKIS

SEQ ID NO: 2442 - protein, 11 aa, Artificial Sequence
  Synthetic
VAGYRLFKKIS

SEQ ID NO: 2443 - protein, 11 aa, Artificial Sequence
  Synthetic
VQGYRLFKKIS

SEQ ID NO: 2444 - protein, 11 aa, Artificial Sequence
  Synthetic
VHGYRLFKKIS

SEQ ID NO: 2445 - protein, 11 aa, Artificial Sequence
  Synthetic
VTAYRLFKKIS

SEQ ID NO: 2446 - protein, 11 aa, Artificial Sequence
  Synthetic
VTSYRLFKKIS

SEQ ID NO: 2447 - protein, 11 aa, Artificial Sequence
  Synthetic
VTGYRIFKKIS

SEQ ID NO: 2448 - protein, 11 aa, Artificial Sequence
  Synthetic
VTGYRVFKKIS

SEQ ID NO: 2449 - protein, 11 aa, Artificial Sequence
  Synthetic
VTGYRTFKKIS

SEQ ID NO: 2450 - protein, 11 aa, Artificial Sequence
  Synthetic
VTGYRYFKKIS

SEQ ID NO: 2451 - protein, 11 aa, Artificial Sequence
  Synthetic
VTGYRKFKKIS

SEQ ID NO: 2452 - protein, 11 aa, Artificial Sequence
  Synthetic
VTGYRFFKKIS

SEQ ID NO: 2453 - protein, 11 aa, Artificial Sequence
  Synthetic
ISGWRLMKNIS

SEQ ID NO: 2454 - protein, 11 aa, Artificial Sequence
  Synthetic
ASGWRLMKKES

SEQ ID NO: 2455 - protein, 11 aa, Artificial Sequence
  Synthetic
VSGWRLMKKVS

SEQ ID NO: 2456 - protein, 11 aa, Artificial Sequence
  Synthetic
ISGWRLLKNIS

SEQ ID NO: 2457 - protein, 11 aa, Artificial Sequence
  Synthetic
ASGWRLLKKES

SEQ ID NO: 2458 - protein, 11 aa, Artificial Sequence
  Synthetic
VSGWRLLKKVS

SEQ ID NO: 2459 - protein, 11 aa, Artificial Sequence
  Synthetic
ISGWRLAKNIS

SEQ ID NO: 2460 - protein, 11 aa, Artificial Sequence
  Synthetic
ASGWRLAKKES

SEQ ID NO: 2461 - protein, 11 aa, Artificial Sequence
  Synthetic
VSGWRLAKKVS

SEQ ID NO: 2462 - protein, 11 aa, Artificial Sequence
  Synthetic
VTGYRLFKKIS

SEQ ID NO: 2463 - protein, 11 aa, Artificial Sequence
  Synthetic
VTGYRLFKKAS

SEQ ID NO: 2464 - protein, 11 aa, Artificial Sequence
  Synthetic
VTGYRLFKKES

SEQ ID NO: 2465 - protein, 11 aa, Artificial Sequence
  Synthetic
VTGYRLFKQIS

SEQ ID NO: 2466 - protein, 11 aa, Artificial Sequence
  Synthetic
VTGYRLFKQAS

SEQ ID NO: 2467 - protein, 11 aa, Artificial Sequence
  Synthetic
VTGYRLFKQES

SEQ ID NO: 2468 - protein, 11 aa, Artificial Sequence
  Synthetic
VTGYRLFKEIS

SEQ ID NO: 2469 - protein, 11 aa, Artificial Sequence
  Synthetic
VTGYRLFKEAS

SEQ ID NO: 2470 - protein, 11 aa, Artificial Sequence
  Synthetic
VTGYRLFKEES

SEQ ID NO: 2471 - protein, 11 aa, Artificial Sequence
  Synthetic
VTGYRLFQKIS

SEQ ID NO: 2472 - protein, 11 aa, Artificial Sequence
  Synthetic
VTGYRLFQKAS

SEQ ID NO: 2473 - protein, 11 aa, Artificial Sequence
  Synthetic
VTGYRLFQKES

SEQ ID NO: 2474 - protein, 11 aa, Artificial Sequence
  Synthetic
VTGYRLFQQIS

SEQ ID NO: 2475 - protein, 11 aa, Artificial Sequence
  Synthetic
VTGYRLFQQAS

SEQ ID NO: 2476 - protein, 11 aa, Artificial Sequence
  Synthetic
VTGYRLFQQES

SEQ ID NO: 2477 - protein, 11 aa, Artificial Sequence
  Synthetic
VTGYRLFQEIS

SEQ ID NO: 2478 - protein, 11 aa, Artificial Sequence
  Synthetic
VTGYRLFQEAS

SEQ ID NO: 2479 - protein, 11 aa, Artificial Sequence
  Synthetic
VTGYRLFQEES

SEQ ID NO: 2480 - protein, 11 aa, Artificial Sequence
  Synthetic
VTGYRLFEKIS

SEQ ID NO: 2481 - protein, 11 aa, Artificial Sequence
  Synthetic
VTGYRLFEKAS

SEQ ID NO: 2482 - protein, 11 aa, Artificial Sequence
  Synthetic
VTGYRLFEKES

SEQ ID NO: 2483 - protein, 11 aa, Artificial Sequence
  Synthetic
VTGYRLFEQIS

SEQ ID NO: 2484 - protein, 11 aa, Artificial Sequence
  Synthetic
VTGYRLFEQAS

SEQ ID NO: 2485 - protein, 11 aa, Artificial Sequence
  Synthetic
VTGYRLFEQES

SEQ ID NO: 2486 - protein, 11 aa, Artificial Sequence
  Synthetic
VTGYRLFEEIS

SEQ ID NO: 2487 - protein, 11 aa, Artificial Sequence
  Synthetic
VTGYRLFEEAS

SEQ ID NO: 2488 - protein, 11 aa, Artificial Sequence
  Synthetic
VTGYRLFEEES

SEQ ID NO: 2489 - protein, 11 aa, Artificial Sequence
  Synthetic
VTGYRLFKKIL

SEQ ID NO: 2490 - protein, 11 aa, Artificial Sequence
  Synthetic
VTGYRLFKKAL

SEQ ID NO: 2491 - protein, 11 aa, Artificial Sequence
  Synthetic
VTGYRLFKKEL

SEQ ID NO: 2492 - protein, 11 aa, Artificial Sequence
  Synthetic
VTGYRLFKQIL

SEQ ID NO: 2493 - protein, 11 aa, Artificial Sequence
  Synthetic
VTGYRLFKQAL

SEQ ID NO: 2494 - protein, 11 aa, Artificial Sequence
  Synthetic
VTGYRLFKQEL

SEQ ID NO: 2495 - protein, 11 aa, Artificial Sequence
  Synthetic
VTGYRLFKEIL

SEQ ID NO: 2496 - protein, 11 aa, Artificial Sequence
  Synthetic
VTGYRLFKEAL

SEQ ID NO: 2497 - protein, 11 aa, Artificial Sequence
  Synthetic
VTGYRLFKEEL

SEQ ID NO: 2498 - protein, 11 aa, Artificial Sequence
  Synthetic
VTGYRLFQKIL

SEQ ID NO: 2499 - protein, 11 aa, Artificial Sequence
  Synthetic
VTGYRLFQKAL

SEQ ID NO: 2500 - protein, 11 aa, Artificial Sequence
  Synthetic
VTGYRLFQKEL

SEQ ID NO: 2501 - protein, 11 aa, Artificial Sequence
  Synthetic
VTGYRLFQQIL

SEQ ID NO: 2502 - protein, 11 aa, Artificial Sequence
  Synthetic
VTGYRLFQQAL

SEQ ID NO: 2503 - protein, 11 aa, Artificial Sequence
  Synthetic
VTGYRLFQQEL

SEQ ID NO: 2504 - protein, 11 aa, Artificial Sequence
  Synthetic
VTGYRLFQEIL

SEQ ID NO: 2505 - protein, 11 aa, Artificial Sequence
  Synthetic
VTGYRLFQEAL

SEQ ID NO: 2506 - protein, 11 aa, Artificial Sequence
  Synthetic
VTGYRLFQEEL

SEQ ID NO: 2507 - protein, 11 aa, Artificial Sequence
  Synthetic
VTGYRLFEKIL

SEQ ID NO: 2508 - protein, 11 aa, Artificial Sequence
  Synthetic
VTGYRLFEKAL

SEQ ID NO: 2509 - protein, 11 aa, Artificial Sequence
  Synthetic
VTGYRLFEKEL

SEQ ID NO: 2510 - protein, 11 aa, Artificial Sequence
  Synthetic
VTGYRLFEQIL

SEQ ID NO: 2511 - protein, 11 aa, Artificial Sequence
  Synthetic
VTGYRLFEQAL

SEQ ID NO: 2512 - protein, 11 aa, Artificial Sequence
  Synthetic
VTGYRLFEQEL

SEQ ID NO: 2513 - protein, 11 aa, Artificial Sequence
  Synthetic
VTGYRLFEEIL

SEQ ID NO: 2514 - protein, 11 aa, Artificial Sequence
  Synthetic
VTGYRLFEEAL

SEQ ID NO: 2515 - protein, 11 aa, Artificial Sequence
  Synthetic
VTGYRLFEEEL

SEQ ID NO: 2516 - protein, 11 aa, Artificial Sequence
  Synthetic
VEGYRLFKKIS

SEQ ID NO: 2517 - protein, 11 aa, Artificial Sequence
  Synthetic
VEGYRLFKKAS

SEQ ID NO: 2518 - protein, 11 aa, Artificial Sequence
  Synthetic
VEGYRLFKKES

SEQ ID NO: 2519 - protein, 11 aa, Artificial Sequence
  Synthetic
VEGYRLFKQIS

SEQ ID NO: 2520 - protein, 11 aa, Artificial Sequence
  Synthetic
VEGYRLFKQAS

SEQ ID NO: 2521 - protein, 11 aa, Artificial Sequence
  Synthetic
VEGYRLFKQES

SEQ ID NO: 2522 - protein, 11 aa, Artificial Sequence
  Synthetic
VEGYRLFKEIS

SEQ ID NO: 2523 - protein, 11 aa, Artificial Sequence
  Synthetic
VEGYRLFKEAS

SEQ ID NO: 2524 - protein, 11 aa, Artificial Sequence
  Synthetic
VEGYRLFKEES

SEQ ID NO: 2525 - protein, 11 aa, Artificial Sequence
  Synthetic
VEGYRLFQKIS

SEQ ID NO: 2526 - protein, 11 aa, Artificial Sequence
  Synthetic
VEGYRLFQKAS

SEQ ID NO: 2527 - protein, 11 aa, Artificial Sequence
  Synthetic
VEGYRLFQKES

SEQ ID NO: 2528 - protein, 11 aa, Artificial Sequence
  Synthetic
VEGYRLFQQIS

SEQ ID NO: 2529 - protein, 11 aa, Artificial Sequence
  Synthetic
VEGYRLFQQAS

SEQ ID NO: 2530 - protein, 11 aa, Artificial Sequence
  Synthetic
VEGYRLFQQES

SEQ ID NO: 2531 - protein, 11 aa, Artificial Sequence
  Synthetic
VEGYRLFQEIS

SEQ ID NO: 2532 - protein, 11 aa, Artificial Sequence
  Synthetic
VEGYRLFQEAS

SEQ ID NO: 2533 - protein, 11 aa, Artificial Sequence
  Synthetic
VEGYRLFQEES

SEQ ID NO: 2534 - protein, 11 aa, Artificial Sequence
  Synthetic
VEGYRLFEKIS

SEQ ID NO: 2535 - protein, 11 aa, Artificial Sequence
  Synthetic
VEGYRLFEKAS

SEQ ID NO: 2536 - protein, 11 aa, Artificial Sequence
  Synthetic
VEGYRLFEKES

SEQ ID NO: 2537 - protein, 11 aa, Artificial Sequence
  Synthetic
VEGYRLFEQIS

SEQ ID NO: 2538 - protein, 11 aa, Artificial Sequence
  Synthetic
VEGYRLFEQAS

SEQ ID NO: 2539 - protein, 11 aa, Artificial Sequence
  Synthetic
VEGYRLFEQES

SEQ ID NO: 2540 - protein, 11 aa, Artificial Sequence
  Synthetic
VEGYRLFEEIS

SEQ ID NO: 2541 - protein, 11 aa, Artificial Sequence
  Synthetic
VEGYRLFEEAS

SEQ ID NO: 2542 - protein, 11 aa, Artificial Sequence
  Synthetic
VEGYRLFEEES

SEQ ID NO: 2543 - protein, 11 aa, Artificial Sequence
  Synthetic
VEGYRLFKKIL

SEQ ID NO: 2544 - protein, 11 aa, Artificial Sequence
  Synthetic
VEGYRLFKKAL

SEQ ID NO: 2545 - protein, 11 aa, Artificial Sequence
  Synthetic
VEGYRLFKKEL

SEQ ID NO: 2546 - protein, 11 aa, Artificial Sequence
  Synthetic
VEGYRLFKQIL

SEQ ID NO: 2547 - protein, 11 aa, Artificial Sequence
  Synthetic
VEGYRLFKQAL

SEQ ID NO: 2548 - protein, 11 aa, Artificial Sequence
  Synthetic
VEGYRLFKQEL

SEQ ID NO: 2549 - protein, 11 aa, Artificial Sequence
  Synthetic
VEGYRLFKEIL

SEQ ID NO: 2550 - protein, 11 aa, Artificial Sequence
  Synthetic
VEGYRLFKEAL

SEQ ID NO: 2551 - protein, 11 aa, Artificial Sequence
  Synthetic
VEGYRLFKEEL

SEQ ID NO: 2552 - protein, 11 aa, Artificial Sequence
  Synthetic
VEGYRLFQKIL

SEQ ID NO: 2553 - protein, 11 aa, Artificial Sequence
  Synthetic
VEGYRLFQKAL

SEQ ID NO: 2554 - protein, 11 aa, Artificial Sequence
  Synthetic
VEGYRLFQKEL

SEQ ID NO: 2555 - protein, 11 aa, Artificial Sequence
  Synthetic
VEGYRLFQQIL

SEQ ID NO: 2556 - protein, 11 aa, Artificial Sequence
  Synthetic
VEGYRLFQQAL

SEQ ID NO: 2557 - protein, 11 aa, Artificial Sequence
  Synthetic
VEGYRLFQQEL

SEQ ID NO: 2558 - protein, 11 aa, Artificial Sequence
  Synthetic
VEGYRLFQEIL

SEQ ID NO: 2559 - protein, 11 aa, Artificial Sequence
  Synthetic
VEGYRLFQEAL

SEQ ID NO: 2560 - protein, 11 aa, Artificial Sequence
  Synthetic
VEGYRLFQEEL

SEQ ID NO: 2561 - protein, 11 aa, Artificial Sequence
  Synthetic
VEGYRLFEKIL

SEQ ID NO: 2562 - protein, 11 aa, Artificial Sequence
  Synthetic
VEGYRLFEKAL

SEQ ID NO: 2563 - protein, 11 aa, Artificial Sequence
  Synthetic
VEGYRLFEKEL

SEQ ID NO: 2564 - protein, 11 aa, Artificial Sequence
  Synthetic
VEGYRLFEQIL

SEQ ID NO: 2565 - protein, 11 aa, Artificial Sequence
  Synthetic
VEGYRLFEQAL

SEQ ID NO: 2566 - protein, 11 aa, Artificial Sequence
  Synthetic
VEGYRLFEQEL

SEQ ID NO: 2567 - protein, 11 aa, Artificial Sequence
  Synthetic
VEGYRLFEEIL

SEQ ID NO: 2568 - protein, 11 aa, Artificial Sequence
  Synthetic
VEGYRLFEEAL

SEQ ID NO: 2569 - protein, 11 aa, Artificial Sequence
  Synthetic
VEGYRLFEEEL

SEQ ID NO: 2570 - protein, 7 aa, Artificial Sequence
  Synthetic
GWRLFKK

SEQ ID NO: 2571 - protein, 7 aa, Artificial Sequence
  Synthetic
GWALFKK

SEQ ID NO: 2572 - protein, 11 aa, Artificial Sequence
  Synthetic
VTGWALFEEIL

SEQ ID NO: 2573 - protein, 11 aa, Artificial Sequence
  Synthetic
VTGYALFQEIL

SEQ ID NO: 2574 - protein, 11 aa, Artificial Sequence
  Synthetic
VTGYALFEQIL

SEQ ID NO: 2575 - protein, 11 aa, Artificial Sequence
  Synthetic
VTGYALFEEIL

SEQ ID NO: 2576 - protein, 5 aa, Artificial sequence
  Synthetic
VTGWR

SEQ ID NO: 2577 - protein, 4 aa, Artificial sequence
  Synthetic
VTGW

SEQ ID NO: 2578 - protein, 13 aa, Artificial sequence
  Synthetic
GVTGWRLCERILA

SEQ ID NO: 2579 - protein, 17 aa, Artificial sequence
  Synthetic
DEVDGVTGWRLCERILA

SEQ ID NO: 2580 - protein, 26 aa, Artificial sequence
  Synthetic
MNVSGWRLFKKISNVSGWRLFKKISN

SEQ ID NO: 2581 - protein, 10 aa, Artificial sequence
  Synthetic
GGSGGGGSGG

SEQ ID NO: 2582 - protein, 8 aa, Artificial sequence
  Synthetic
EDAKNIKK

SEQ ID NO: 2583 - protein, 9 aa, Artificial sequence
  Synthetic
VGKLGRQDP

SEQ ID NO: 2584 - protein, 9 aa, Artificial sequence
  Synthetic
RGKLGRQDP

SEQ ID NO: 2585 - protein, 9 aa, Artificial sequence
  Synthetic
LGKLGRQDP

SEQ ID NO: 2586 - protein, 23 aa, Artificial sequence
  Synthetic
YIYGAFKRRGGVTGWRLCERILA

SEQ ID NO: 2587 - protein, 12 aa, Artificial sequence
  Synthetic
MGSMLFRVTINP

The invention claimed is:

1. An isolated composition comprising:
(a) a polypeptide comprising SEQ ID NO: 1270;
(b) a first peptide comprising SEQ ID NO: 2587; and
(c) a second peptide comprising SEQ ID NO: 374.

2. The isolated composition of claim 1, wherein one or more of the polypeptide, first peptide, and second peptide are conjugated to a molecular entity.

3. The isolate composition of claim 2, wherein the molecular entity is selected from the group consisting of a small molecule, antibody, antibody fragment, peptide, carbohydrate, or protein.

* * * * *

UNITED STATES PATENT AND TRADEMARK OFFICE
CERTIFICATE OF CORRECTION

PATENT NO. : 10,184,936 B2
APPLICATION NO. : 15/899219
DATED : January 22, 2019
INVENTOR(S) : Andrew S. Dixon et al.

It is certified that error appears in the above-identified patent and that said Letters Patent is hereby corrected as shown below:

In the Claims

Column 168, Claim 3, Line 21 should be corrected to read:
The isolated

Signed and Sealed this
Seventh Day of May, 2019

Andrei Iancu
*Director of the United States Patent and Trademark Office*